United States Patent 11,098,302 (IDENTIFICATION OF POLYNUCLEOTIDES ASSOCIATED WITH A SAMPLE) - sequence listing, part 79

SEQ ID NO: 271888 - DNA, 763 bp, Homo sapiens
  misc_feature: GYAE6OF01D44KT.13.39.D06.1.454.CMB.1.raw
  modified_base (179)..(179): a, c, t, g, unknown or other
  misc_feature (179)..(179): n is a, c, g, or t
tcagtcacgtactacacgaccggtgctcgatttagtgacatctcgcagttcgtttggggctgggcctcaggaagcagcatcggaggtgcctcagccatggcatggatccctctcttcctcggcgtccttgcttactgcacaggatccgtgcctctatcgagctgactcacgcctacctnagtcgtccgtcgtcccaaggacacgacagaccgagcctactcgactcgtctacgtaaggaaaattaaacgttggacaaggtaattaaaacgttacttaaccgtttaccgtaggtaactccgaagacgaagtaacgttaccggacggtccctaccggtttaccccgtggttccgtacgttcggtacctaattccgtaatacgtaaagcttcggaaccgtaaccggcccggtaccctacggacggtaccttcccgaggacgtccttacttccgtcgtacggtcccttaaccgtaacgttcggtacggtaacctccgaacctaccctcgtacgtacgaacctacgtacgaccgggacccggaaccgtaggtacgtaaggtcggtaacgcggtacggtacgtaacgtacctttaaggttaccgtaggtaccggacgggtacggtaaccgggacgacgtacccggactacccggacgttccccggtacgtaccgtttacgtccgggtttaacccgggttacgtaaacccgggttacccggggaaacttaacccggggttaccccgttaaccggttacccgtaacccggg

SEQ ID NO: 271889 - DNA, 810 bp, Homo sapiens
  misc_feature: GYAE6OF01CDKJZ.13.39.D06.1.454.CMB.1.raw
  modified_base (246)..(246): a, c, t, g, unknown or other
  misc_feature (246)..(246): n is a, c, g, or t
  modified_base (385)..(385): a, c, t, g, unknown or other
  misc_feature (385)..(385): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatggacccagtctccagacctccctggcttggtgtctcgtgggcgagagggcccacatcaacgtgcaagtccagccgagtagttgttttanacgactactaccaaacaataaacgtaacctttcgttacgtcgtttacggtaaccaggaccgaaacgtaaaaccgacggtaaccgaccggtacccttaacccgtaacgtccgtacgtaccttacgtaacgttttaaccgnggggacctaacgttactaaccggtaccggggtaaccgttcccggggtacccttaggaccccgttaagttccgtaacggttcgggaccgtaacggggccggggttaccgttacggggaaccttaggttaactttcaaccgttctaccgtaacctactaccgagaccgtaacgtccggacgtaccggacgggtacttagaaacgtacgtcgggttaccgtaacgtttaggttttaaccgtttaaccgtcgtaacggtaacccgtaaggttaaactttaacgttaacggtttacgtaacccgtttacccgtccgggtaaaggttccctttaacggttaacccggtttcggggaaaccggggtaacgggaaccccggttaaagggtacggtaaacgaagttaacccgaaaacgggttaccggttaaggg

SEQ ID NO: 271890 - DNA, 745 bp, Homo sapiens
  misc_feature: GYAE6OF01EVXJF.13.39.D06.1.454.CMB.1.raw
  modified_base (250)..(250): a, c, t, g, unknown or other
  misc_feature (250)..(250): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacgggacatcgtgatgacccagtctcagactccctggctgtgtctcgtgggcgaggacgggaccaccgatacaactcgacgtaacgtccgagccagacgttgtttttanacagcctaccaaacgtaataagtacttctagtcttaggtaccagcaagaaaccaggtacacgccttactaagctcgctctagtttacgcgggtctaacttcgttaacggtccgggtaacgtcccgggtccctacggaaccgtacgttcgaaggttcggacgacgggttcggggtactacggggactaacggttctttaccgacgttaccctaccgaccgtactacgtaacggcctaaccgtccgttcggaccgtaacggtccgttaaggaaagttcggtacgggttacggttacctaagtttttaaccgttaacgtcggtaacctacggttaacttaaacgttagttaaaccgttaccggttaaccctaccggtttacccgtaaacgggtttccgttaaccggtttacgggttcccggggtaaaccggggaaccgtaaccccggtaaagggttacgggtaacgtaacgttaacccgtaaaaggtccggttacggg

SEQ ID NO: 271891 - DNA, 892 bp, Homo sapiens
  misc_feature: GYAE6OF01DBZGK.13.39.D06.1.454.CMB.1.raw
  modified_base (252)..(252): a, c, t, g, unknown or other
  misc_feature (252)..(252): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggcggccaccatcgaactgacaacgtccacgccgagtaggttagtttanacacgtcctaccaaaactaaattaaacgtaaacctttcgttaacgttccgttaacggtaccaacgacgaaacgaaaacccgaggaaccgaccgtacccttaccgtaacgtcctcgccttactaacgttttacggcggactacgtacgtaacgtcccggggtaacgttcccggggttacccctacgggtaacccgtagtttacggaacggttcgggaccgtacggggtccggggttaccgtaggggtaacccgttaaggttaaccgttttacccgtacccgttaccccttacctaacccgttaagtaacccgtacggtacccggtaaccgtaccccggtacggtcccggtaaacggggtaccgttaaaggaaacggttacggttacggggttacggtaaccggtttttaaacgttttaacgttaacccggtttacgtaaccgttaacgtaaccgtttaaagttttaagtttaacccgttaacggtttaacccccttacccgggtaccgggttaaaccgtccccggtttaacgttacccggggtttacccggggacggggtaacccggggaaaccgggttaaacggggtaacgggtaaacccggtaaggttaaacctaaaacggggggtaccgttaccgggg

SEQ ID NO: 271892 - DNA, 785 bp, Homo sapiens
  misc_feature: GYAE6OF01EBQDT.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctcgtgggcgagacggccaccgatcaactgacaagtccagccagtagttgtttatacgagcctacaaacaaataagacttctagcttgtaccagcaagaaaccaggacacgcctaccgtaagtctacgcttactaacgttttacgacgggactaacgttaccgtaacggttacccggggtaaacggttcccccgggggttaacccctaaccgggaaccccggtttaacgtttacccggaacgggtttacgggaccgtaacggggtcccgggggttacgttaacggggggaaacctaacgggtttaaccttttacccggtaaccctttccggttaacccctaacccgtaaccgtttaaccggtaacccggccgtaaacccgggtcccgttaacgggaccgtacgggtaaccgtaaagggtaacggtaacgttcgggtaacggttaccgttttaagttttaacgttaccgtacgttacgtaacgtacttaaattaacgttagtaccgttactcccgtccggtacgtacgtacgttaccggttcgggaaccggtagggaaccgaagggttacggaacgtacgaacgaaacgtacgtacggg

SEQ ID NO: 271893 - DNA, 887 bp, Homo sapiens
  misc_feature: GYAE6OF01CECOU.13.39.D06.1.454.CMB.1.raw
tcagtcacgtactacacgaccggtgctcgatttagtgacatctcgcagttctttggggagctacaacaggcaggcaggggcagcaagatggtgttgcagacccaggtcttcatttctctgttgctctggatctctggtcgcccgacggggacatcgtgatcgacccagtctccagacctccctggctgtcgtctcgtgggccgaggacgggcccaccagtcaacgtcgacgaacgtccagccaggtagtttgtttacacgagaccttaccaaactaaataaacgtaacctttacgttaacgcgtttacggtaacccaggacctaaacggaaaacccaagggaaccaacgtcccttaaccgtaaacggcctacggtccttactaacgttttaccggtacgggtctaacttaccggttaacggtaacccggggttaaccggttccccgggggttaccccgtacggtaacccggtaacgttttccgaaacgggttcggacgtacggggtccggggttaccggttgggaacctaacgggtttactttacccgttaaccttcccgttaacccgaccgtaccgtacgaaccgaccgtaaccggtacccgttacgggacccgtaacgggtaccgttaggtaacggttagttcgggttacggtacgttttaacggttttaacgtttacgtacggttaccgtaacggttaacttaaacgtttagttaaccgtttaaccgtacccgtttaccccggtaaccgggtaccggtttacccgttaaccggtttacccggtttaccgggggaaccccggggtaaacgggttaaccccgggtaaacggggttaacgggaaccggttaaacccgttaaaacccggtaaacgggttaaacccggg

SEQ ID NO: 271894 - DNA, 689 bp, Homo sapiens
  misc_feature: GYAE6OF01AC1V4.13.39.D06.1.454.CMB.1.raw
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagtcacgtactacacgaccggtgctcgatttagtgacatctcgcagtttcgtttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgcaagtccagccagacgtgttttatacagctccaaacaataagaacttcttagcttggaccngcagaaccnggacngtctcaagctcgctctatttacgtggctactcgtacgtccgggtaatcccgggtccctgacccgtagttcgagtcgggctacggtccggggtctcggggtaactacggtacttttaccgacttcctccgaacctatacccgtacgtcgacgtcccgttacggacgtacggtccgtaacgtaacggtacgtcggttacggtacgttaacgttttacttaacgttacggttacgtaacggtactaacgttacgtttaacgttaacgttaccgttacccgtaccggtaacggtaccgtttccgtaacccggtttttaccgggaccgggttaaccgggtaacccgtaaacggggttacggtaacggtaaaccggtaccgtaaaaccggtaacgttacggg

SEQ ID NO: 271895 - DNA, 849 bp, Homo sapiens
  misc_feature: GYAE6OF01CO64S.13.39.D06.1.454.CMB.1.raw
  modified_base (181)..(181): a, c, t, g, unknown or other
  misc_feature (181)..(181): n is a, c, g, or t
tcagtcacgtactacacgaccggtgctcgatttagtgacatctcgcagttctttgggggctacaacaggcaggcaggggcagcaagatggtgttgcagacccaggtcttcatttctcttgttgctctggatctctggtgcacgacgggacatcgtgatcgacccagtctccagacctcccnggctgtgtctcgtgggcgaggacgggccaccatccaacgtgacacgtccacgaccgagtagttatttacgacgacgtacctaccaaaactaaacgttaacgtaacctttacgtttacgtacgtttacggaccctacggaccgaaaacgaaaccgaaggaccaacgtcccttaaccgacgtcttaccgtactacgttaacgtttacggtcggactacgttaccgttacgggtaacccggggtaccggttccccggggttaccctaacggtacccggttaagtttaccgtacgggtacggtaccggtacggggtccgggggttaacggtacgggaacgttaacgttacccgtttaccacccgtttaccctaaccgtaccgtacgtaacccgtacggtacgtaaccggtccggaacgtacgggaacgtcgtaaaggtaacggtggtttacggtacgggtttactttaacgttttaacggtacgttacgtaaccgtattaacgtttaaatttacggttaaaccgttccgttaacccgtcccggttaccggaaagtttcccccgttaaccgggtttaccgggttcccggggaaacggggttaacccggtacgggtttaaacggggtaaccggtaaccggttaaactaaaccgggtaaaccgggtttaaaccgg

SEQ ID NO: 271896 - DNA, 669 bp, Homo sapiens
  misc_feature: GYAE6OF01ECWP5.13.39.D06.1.454.CMB.1.raw
  modified_base (250)..(250): a, c, t, g, unknown or other
  misc_feature (250)..(250): n is a, c, g, or t
tcagtcacgtactacacgaccggtgctcgatttagtgacatctcgcagttcgtttgggggctacaacaggcaggcaggggcagcaagatggtgttgcagacccaggtcttcatttctctgttgctctggatctctggtcgccgaggggacatcgtgatcgaccctatcctccgagaccttccgtcggctgtgtcgtcggtgggcgaggacggccacatacacgtgactacgtccagcagtagttgtttanacagcctacgaataataacgtacttcgtagtcttacgacagaccgaagaacgtacgacgacgacctacgtacgtctcgtactacgtagttcgtggactacttcgtacggtaccggtaacggtccccggtccgtcgaccgtagtacgtcggtacgacggtacggtccggtagtacggactacgttcgttactacgtcctacgaacctagacgtacgtcacgtacgcgacggtcgtacgtagaacgtgtacggttacgtatttaagttccgttaaggacgttacgtaacctagttaaactttacgtacgttaccggtaccgttcccgtacggtaaccgttccgtaacggttccgggttacggaaccgggtaccggaaacggttggtacgaaaccgttaagtaccgtaacggttgtaacggg

SEQ ID NO: 271897 - DNA, 764 bp, Homo sapiens
  misc_feature: GYAE6OF01A1BY2.13.39.D06.1.454.CMB.1.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (625)..(625): a, c, t, g, unknown or other
  misc_feature (625)..(625): n is a, c, g, or t
  modified_base (650)..(650): a, c, t, g, unknown or other
  misc_feature (650)..(650): n is a, c, g, or t
tcagtcacgtactacacgaccggtgctcgatttagtgacatctcgcagttctttgggggctacaacaggcaggcagggcagcaagatggtgttgcagacccaggtcttcatttctctgttgctctggatctctggtcgcccgacggggacatcgtgagtcgacccagtcctcagcctccctggctgtcgtctcgtgggacgaggacgggcccacactacaaactcggactacgtccgacgcctaggtagtttcgttttanacgacncctaaccaaacaaacttaaagtacctttacgttacgtcgttacggaacccaggaccaaggaaacccgaacgggacttaccggacccgttaccgtaaactcggttacaccgttacttaaggtttaaccctgggaacttacttaccgttaacgtaccccgggggtaaacgttccccggggttaccacgggtaccctacgtttacggacggtacgggccgtagggaccgggttcagggtaacctgtaccctttagaccttccgtactaaccgcgttagaaccctgaccgccgttacgacgacgggaaccttaggagtagtacggttagtacgttaacgttcgtaacctttgaccgtacgtanaagttttaacttagtaccgtttacnccggtttaccgagtccccttacggttacccgtttcgggggaaacgggttaacccggtaaacgtcggggttaaacgggaccttaaaacggacccttaaaggaaccccgtttgggg

SEQ ID NO: 271898 - DNA, 731 bp, Homo sapiens
  misc_feature: GYAE6OF01BDJ9F.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggactagtcgtgactcgaccctagtcctccagtcctcccgtggtctgtcgtctcgtcgggcgaggacggccacctatcaacgtcgactaacgtccagccgtaagtagtttcgtttaacacgacgtccctaaccaaaactaaagttaaacggtaacctttacgttacggtaccgtttacggaaacccgtacgaaccgtaaacggaaaacccgacgggtaacctaccggtaccccttacgtaaacgtccgttacgtacctttacgtaagtttccggtggtacctacgttaccgttaacgggtaacccgggtaaccggttccccgggtcccgtaacgtaacccgttagttacggtacggtcgggacgtccgggtcgggttacgacggaactacgttccttactaccgtctaccacgtactcgacgcgtcgactgacgcgtacgtagacgtgtcgtactacgttacttctacgtgtactagtactacgttattacgtaccttcgacgtacgtacgtccgttacgttacgggtacgggaccggtaacgtcggtaacggtcggaacgtactaaacgtaaacggtcgtcgg

SEQ ID NO: 271899 - DNA, 889 bp, Homo sapiens
  misc_feature: GYAE6OF01CJIGO.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggattctcgtggtcgcccgacgggacagtcgtgacgtcgacccagtcctaccgacgtacctcccgtggctggtcgtctcgtgggcgaggacggccaccataccaacgtcgaccaacgtccgagaccgtaagttacgtttagtttacaaccgagtaccttaacccgaaaataaacgttaaacgttaaccttttacgttaacggttaccgtttaacggaaccgtaacgaacctaaaaccggaaaccgtaaacgggaccaccggttaccccgttacgtaaacggtcctagtacccttactttaacgttacgtcggacttaggtacccgtaacggtccgggtaacccggtttcccgggtacccttaacggtacccgttaacggttccgtaagggtccggacggtaaccggggtccgggttaaccgtacgggaaccttaacggttacttttacccgaacctaccctaaccggtaacctacttaccggacccgacgtacccgtccgtaacggccgtaaacgggttccaagggaacgtttacggttcggtacggttacctttttaaggttaacctttaacggtcgtttaaaccgtagttaaacttaaagtttaaccgtttacggtaaaccttcccggttcccggttaaacggggccctttacgtttaacccggggttacggtttacccggggggaaacggttaccggggtaaacgtaaggggtaaccgaaacgtaaccggtttaaacggaaaccgggtttcggtacgggg

SEQ ID NO: 271900 - DNA, 824 bp, Homo sapiens
  misc_feature: GYAE6OF01D5RFB.13.39.D06.1.454.CMB.1.raw
  modified_base (252)..(252): a, c, t, g, unknown or other
  misc_feature (252)..(252): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatcgacccagtctccagacctccctggctgtgtctcgtggggcgaggacgggccaccagtaccaacgtgacaagtccagaccagtagttgttttanacacgacctaccaaactaaataacgtaactttacgttacgtccgtttcggtaaccagtaccaaacggaaaacccgacgggaaccaaccggtaccccttaccgtaaacgtccgtacgtccttaaccttaacggttttaccgtacgggtacctactttaccgtaaccggtcccggggtaaaccgtttccccgggggtacccttacggaacccgttacgtttaccggtaaggtcgggaccggtacgggttccggggtacgtagggggtaacctaggtttaaacctttcccgtaacccttcccgttaaccccgaaccgttaacgtacccgtaacggacccgtaccggtccgtacggtccgtagggtaccgtaaggtacgtagttcggtagggtactttaggtttactttaacgtacgtacgtagtaacttaatttacgttacttacgtacccgtaccgtaccgtacggttacccgttaccggttaccgggtttaccggggaccgggtaaaccgggtaccggtaaacgggtacgggtaaacgtaacgttaaacccggaaaccggttggtaaccgggg

SEQ ID NO: 271901 - DNA, 744 bp, Homo sapiens
  misc_feature: GYAE6OF01AXK99.13.39.D06.1.454.CMB.1.raw
  modified_base (244)..(244): a, c, t, g, unknown or other
  misc_feature (244)..(244): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctcgtgggcgagacgggccaccatcaactgacaacgtccagccagtagttgttttanacacgtcctaccaaactaataaacgtaacctttcttaagtcttacggtaccagacaacgaaaccaggacacgccctacgtaacgctcgctactactttacgtcgggtactagttacgtacgtacccgggtaacgttcccggggtacccctacggtacccgtaacgttcgaacggtcgggacgtacgggtcggggtacgtacggggtaacctaggtacctttacgtacccgttccgtacccaaccgtactaccgacgtccgaaccgtcccgtacggtaccgaacggtaccggttacggaaaggtacgttgggtacggtacgtttaacgttttaccttaacggttcgtacgtaacgttacttaaacttaagtttaactaacgttaacctcccggttaccggtacggttccttaccggttaccggtttacggggaccgggtaacgggtaaaccggtaagggtacggtaacggtaaccgtaaccggtaaacggtcggttacggg

SEQ ID NO: 271902 - DNA, 787 bp, Homo sapiens
  misc_feature: GYAE6OF01CI0R1.13.39.D06.1.454.CMB.1.raw
  modified_base (200)..(200): a, c, t, g, unknown or other
  misc_feature (200)..(200): n is a, c, g, or t
  modified_base (773)..(773): a, c, t, g, unknown or other
  misc_feature (773)..(773): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggactctctggtacgcccgacgggacagtcgtgactcgaccctagtcctacagcctcccgtggctgtctctcgnggcgagacggccaccataccaacgtgacgaacgtccacgacctaggtacgtttgttttaacacgacgtacctaaccaaaacgtaaattaaacgttaacctttacgtaacgttaccgttacggaaccagaaccgaaacgaaaccgaggaacacgtaccctacgtaacgctacgtaccttatacgttttaacgcggtactacgttacgtaacgtccgggtaaccgttcccgggcctaaggtacccgtattacggtacggtacgggtcgtaaccggggtcggttaacggacgggtaacctaggtttaaccttttacccgaaccgttccctaacccgtaacccgtaacgtacccgtacggtaaccgtaaccggtcccgttagacccgggtaagggttaccaaagggtaccgtagttcgggtaacccggtttatttaaacgggtttactaacggtccgtagtaaacgttacgttaaattacgttaacggttaccttacccgttacgaccggtacgttccgttaccggtccgggttaacgggcgggtaaccggtaacgtaggaccgtacaaaccggtanaaaccggtcgttgg

SEQ ID NO: 271903 - DNA, 876 bp, Homo sapiens
  misc_feature: GYAE6OF01BQ9IA.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacgggacatcgtgatcgacccagtctccagacctcccgtgctgtcgtctcgtggcgaggacggcccacatacaacgtcgactaacgtcccacgaccgtaagtacggtttagttttaactaccgacgtacccttaacccaaaacgtaaaacgttaaaacggttaaccgttttaccgtttaacggttaccgttttaaccggtaacccgtaacggtaacccgtaaaacggtaaaaccccgaacgggaaccctaacccggtacccccttaacccggtaaaccgtccgttacgtacccgttacgttaacggttttacccgacggggtacctaaccgttaccgtaaccggttacccggggtaaccggttccccggggttaccccgtacggtacccgtacgttacgtacgggttacggaccggtacgggtcccgggtacggtacggtaaccgtacggttaccttaccgtacccgttcccgtaacccgacccttaaccggttaccgaacggtaccgtaccgtaccgtcggaaccggtacggtaacgtagtaaacggtggtcggtttacggtaccgtttaagttttaacctcgtaacggtcgaagttacttaaacgtttacgttaacgttaccttacccgtaccggtaacgtacggttacccgtacgttacccggggttacggacggggttaaccgaacgggttaagaccggttaactaaccggaacgtaacgtacggtcgg

SEQ ID NO: 271904 - DNA, 793 bp, Homo sapiens
  misc_feature: GYAE6OF01CF8E5.13.39.D06.1.454.CMB.1.raw
  modified_base (166)..(166): a, c, t, g, unknown or other
  misc_feature (166)..(166): n is a, c, g, or t
  modified_base (317)..(317): a, c, t, g, unknown or other
  misc_feature (317)..(317): n is a, c, g, or t
  modified_base (779)..(779): a, c, t, g, unknown or other
  misc_feature (779)..(779): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccngtctccagacctccctggcttgtcgtctcgtgggcgaggacgggccaccataccaactgacaacgtccagccagtagttagttttactacacgtccttaaccaaactaattaaacgtaacctttacgttacgtccgtttacggtaacccanaccgtaaacggaaacccgacggacctaccggaccccttactaacggtctcgtccgttacttacgtttaccggcgggtacctacttaccgtaaccggttaccggggtaaccggttccccggggtacctacgggtaacccgttaacgtccgtaagggtccgggtcgtaacggggtccgggtttacgacggggtaactacggtttaacttttaccggaccttaccccgttacccgtaacccgtaagttaccggaaccgacccggttaaccggccgttacggaccggtacggttaacgtttaacggggaaaaccttggttttacggggtacggtttaaccgtttaaccgttttaagtccccggttaaggtaccgtacgttaaccttaaagtttacttacgtacgttacccttcggacccgtgtccttaacgtcggttacgggacgacgggtacgaggtcgtacaanaacgtaagtggtcg

SEQ ID NO: 271905 - DNA, 948 bp, Homo sapiens
  misc_feature: GYAE6OF01DGZT2.13.39.D06.1.454.CMB.1.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
tcagtcacgtactacacgaccggtgctcgatttagtgacatctcgcagttctttggggagcttcagctgtggtagagaagacaggattcaggacaatctccagcatggcccggcttccctctcctcctcacccctcctcactcactgtgcagggtcctgggcccagtctgtgctgactcacgccaccctcagcgtctccggggacccccggnaggaggtccaccatccttcttgttctagggaacncgagcctacccaacgagtaccgggtaagttaaatttagtagttaagttaagtttcggtaattcgaagtccgaggtcccctaccccgaacgggggaaaaccccggacccccaaaaccgacgtacctaccgaacttaccgttaaataacgggtaaataaactccgacggtccccggtacccgtacggtaccgggttccccctacgggtaacccggtactttcccgtacgttacgggtcccttaacccgaacggtttccgtcggaccctaacccgtttccgaccgtcccccgttcccgaacccgggtcctaaccgtcgaaccgggtttccggaccccttaccgtacggtttaccccgtagggggtaaccggtacgttaggggttaaccgggtactttacgggtttaaacctttttaaggtttaaccgttacgggtaccgtacccgggttaaacgtacccttaaacgggttttaaacccctagggttaacccggtaaaaccccccgttttaacccggttaacggggtttaaaacggtttttcccggggggtttaaccgggttttttagggggggtttacccccggggtttacgggggaaaccccggggggtaaacccgggggttaaccccgtaaaacggggttccccgtttaaccggggttaaaccccgggtttaacccggtttaaccccgggtaaacccccgggg

SEQ ID NO: 271906 - DNA, 997 bp, Homo sapiens
  misc_feature: GYAE6OF01AMKIA.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgaggacgggcccaaccataccaacgtgaccaacgtccgagccagtagttagttttacacgacgtacctaccaaactaaataaacgtaacctttacttagtccgtttacggtaacctaagaccgaaacggaaaaccgtagggacctacggaccccttaccgtaaacgtccgttacgtaccttactaacgttttacgtacggggtacctaacgttaccgtaacggtaccccggggtaaaccggttcccccgggggttaaccccgtaccgggtaacccggtaacgtttaccgggtaacggttccggggaccggtaacgggggttcccggggtttacccgggtacgggggtaaccgttaccgggttaaccttttacccgtaacccgtttacccgtaaccccgtaaccccgttaacgtaccccgtaacgggtacccgtacccggtcccggttacgggaacccgggtaacgggttacccgttaaaggggtaaacggtacggtttacggggttaccggttaaccggttttaaacgtttttaaccggttttaaccgttaccgggttaacgtaaaccggttaaaccgttaaacgttttaacgtttaacccgttaacccgtttaccccggtttaccccggttaacccgggttaaccgggtttacccggtttaacccggtttaaccggggtttaacccgggggacccggggttaaaccggggtaaaccccgggttaagggggttaaaccggggtaaacggttaaacccggtaaaccggttaaaacccgggttaacgttaacccggggg

SEQ ID NO: 271907 - DNA, 732 bp, Homo sapiens
  misc_feature: GYAE6OF01CAMRE.13.39.D06.1.454.CMB.1.raw
  modified_base (268)..(268): a, c, t, g, unknown or other
  misc_feature (268)..(268): n is a, c, g, or t
  modified_base (390)..(390): a, c, t, g, unknown or other
  misc_feature (390)..(390): n is a, c, g, or t
tcagtcacgtactacacgaccggtgctcgatttagtgacatctcgcagtttctttgggggctacaacaggcaggcaggggcagcaagatggtgttgcagacccaggtcttcatttctctgttgctctggacttctctggtcgcccgacggggacagtcgtagatacgacccagtcctccacgacctcccgtggtctgttcgtctcggtgggcgaggacggaccacatcaactgacaacgtcacgaccgtaagtagtttaggttttaanacgacgaccttaaccaaaacgtaaagtaacgttaacttcgtaacgttaccgttacggaaccagacaaacggaaaccaggaaccacgtaccctacaacgtctacgtacttactaacgttacgnggtacctaagtaccgtaacggtaccgggtaaccgtcgggtaccctagggacctagttcgacggtcggacgtacggtcgggtacgtaggaaacctggttaccttcgaaccttcgtaacaccgtaacgttaccgagtaccgtagtacccgtagaccgtacgtagaacgaagttcgagtacgtagttacttacgttacgacgtaacgtacaacttaaggttacttaacggaccgttacctaccggtaccgtacggttaccgttccgtaacccgggttcggggaacggtaacgggtaacgtaacggggttaacaacggtacaaaccggttaacggacggtttacgg

SEQ ID NO: 271908 - DNA, 935 bp, Homo sapiens
  misc_feature: GYAE6OF01C3L6C.13.39.D06.1.454.CMB.1.raw
  modified_base (166)..(166): a, c, t, g, unknown or other
  misc_feature (166)..(166): n is a, c, g, or t
  modified_base (212)..(212): a, c, t, g, unknown or other
  misc_feature (212)..(212): n is a, c, g, or t
tcagtcacgtactacacgaccggtgctcgatttagtgacatctcgcagttcgtttggggggggtctcaggaggcagcactctcgggacgtctccaccatcggcctgggctctcgctcctcctcagcctcctcactcagggcacgaggactccgtgggtctcagtcncgcctgactcacgtcctcgctacgtgtcgtccggtctacgagacgngtcacgtaccacacttccgtctgactacgtacgaacgtacgcgtagtacgtacgtaggttaggttaacttaacgtaacgtacgtttcgttaccgtacgttaaaccggtaaccaaaacgtaaccgtaaccggtacggaaaacccgtaaaaccggaaaccccttaaaacggttactaaacgttcgttaaagtttaacgtagtttaacggacgttaacggtacgtaaccgggtaccggtacccgttacggggaccggtacgttaacgtaccggttcgtaccgtttcctaccggttacgtaaccgttaacgtacggttcccgggaacgtaacccgtaaaccggttacccgttacccgttaacccgtaacggtacccgttaacgttcccggtacggttacccgggtaccgttaccggtaacgggtaccggtaacgtttaacgggtacgttacggggttacggttactttaaacgggttactttaaaccgttcggaaccgtttaccggtttacgttaccgttaacggtttaacgttaaccgggtaccggttaaccgggtaaaacggtcccgaaacggtttaacccgaacgggtttaaaccccgttagggtttaaaaccgtttaccgggggaaccgggtaaaacccgggtaccgggttaaaacccgttaccgggtaaacccgggtttaaccgttaccccggggtaaccttaacccgggggttaaaccccg

SEQ ID NO: 271909 - DNA, 912 bp, Homo sapiens
  misc_feature: GYAE6OF01CH6EN.13.39.D06.1.454.CMB.1.raw
  modified_base (898)..(898): a, c, t, g, unknown or other
  misc_feature (898)..(898): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctcgtggatctctggtcgacccgacggggacagtcgtgactcgacccctagtcctaccgacgtaccctcccgtggtctggtcgtcctcggtacggggcggaaggaccgggtacccaacctataccgaaacgtcgaacgaaacggtccaacggaccgtaaggttacggttttagttttaacaacgtacgacctaacccgaaaataaaacgtaaagttaaccgtttacgttaagtaccgtttaccggaacccaaggacccaaaacggaaaccctagggaaccctaaccgtaccccttaaccgtaaacgtcctacgtacctttaaccgtaacgttttaccggcggttaactaaccgttacgttaaccgggtaaccccgggtaaccgggttccccgggttaccccgtacggtaacccggtaacgtttaccgaacggggttcggaccggacgggggttaacggggttcccgtaaggggttaaccctaaagtaccgtttcccaaccggttcccacctaaccgtactacgaaccgtacgtacgccgttcgaacggtacgagtaagacgtagttcgggtagtaacgtttaagttacgttacgtacggaacctaattaaccttaaagttaacgtttaacgttaaacccgtacccggtttaccgaacccgggtacgttaccccgttaaccgggtttaaccggggttcgggggaaaacccggggtaccgggtaaaacgggtaacggtaacggggtaaactaaaaccccggtaaacggtaaacccggngggttttacccggg

SEQ ID NO: 271910 - DNA, 842 bp, Homo sapiens
  misc_feature: GYAE6OF01CHZUG.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctcgtggtcgcccgacggggacagtcgtgagtcgacccagtcctaccacgacctcccgtggcttgtgtccgtcgtgggacgaggacgggccaaccgataccgtaaacgtcgacctaaacgtcccgaacgaccgtaaggttacggttttagtttttaaccaacgaccggtacccttaacccgaaaaacgttaaaacgtttaaaccgtaaacccgtttttaccgtttaaggtacccggttttaccggtaaccccgtaaacggaaccgtaaaaccgggaaaaacccgacggggtaaaccctaccgtaccccgttaacccgttaaaggcccgttaccggtaccctttacgtttaacttttccggacgggtaccttacgttacccgttacgggtaacccggggtaacccggttacccggggttccctacgggtaaccgtacgttaccgaggttcggacgtacggggtcggtacccggtaaggaccgtaagttacctttcgaccgttaccgaccttaccgatcgacgtctacgtccgtagacgtacgtcgtaagagttcgtagtcgttaacgttagttacgtacgtacgtagaccttattaaagtttacgtactacgttacgtcccgtacggtacttccggtacggtacccggttaggggaaccggtaacggaccgtaacgggtgtaacgtaaccggtacctaaaggttcggtacggg

SEQ ID NO: 271911 - DNA, 746 bp, Homo sapiens
  misc_feature: GYAE6OF01EBTGR.13.39.D06.1.454.CMB.1.raw
  modified_base (160)..(160): a, c, t, g, unknown or other
  misc_feature (160)..(160): n is a, c, g, or t
tcagtcacgtactacacgaccggtgctcgatttagtgacatctcgcagttctttggggggctacaacaggcaggcaggggcagcaagatggtgttgcagacccaggtcttcatttctctgttgctctggatcctctggtcgcccgacggggacagtcgtnagtcgaccctagtcctccaacgtacctccccgtggtcttggtcgttccgtcggtcgggacggtacgggacgggccctaacctataccgaaacgtgaacctaacgtacccgacgaccgtaagttagtttacgttttaactaccgacgtacctaactaaaactaaataaacgttaaccttacttacggtacgttacggaaccacgtaaccgaaacggaaccaaggaccgaccgtcccgttaaccgaacgtcgtactaccgtttagtaacttttacggcgtacctacgttaccgtacgggtaccgggtaccggtcccggtacctacggtaacctgtacggacgtcggccgtaggggtccggtggtacggtaacgtattacttactacctcgtaccactatcgagtcactcgcgagtcggactagagtacgtgtacgtagttacgtttaactcgtagtacgtacgtaaactttattaagttactaccgaccgttcccgcggtacttaccgtcggttaaccggttaccggggacgggtaaaccggacgttaacggagggtaaacctagtaacccggtaaaggtcgtacggg

SEQ ID NO: 271912 - DNA, 746 bp, Homo sapiens
  misc_feature: GYAE6OF01CE24J.13.39.D06.1.454.CMB.1.raw
  modified_base (579)..(579): a, c, t, g, unknown or other
  misc_feature (579)..(579): n is a, c, g, or t
tcagtcacgtactacacgaccggtgctcgatttagtgacatctcgcagttctttggggggctacaacaggcaggcaggggcagcaagatggtgttgcagacccaggtcttcatttctctgttgctctggatctctggtgcccacggggacatcgtgatgacccagtctccagacctcccgtggctgtgtctcgtggggcgaggacgggcccaaccatccaacgtgacaagtccagccaggtagttgttttacacacgctacccaaactaaataaacggtaacctttacttacggtacctttcgggtaaacccaggtaccaacggaaaaacccctacggggaacaccggacccgttaacctaaaggccgtacggtcctactagttttaccgacggggtacctagtcttaacgtacccggggtaaaccggttccccgggggttaccctcgggaacccgtagttacgaggttacgggcgacgggtcggggtccgtaggggtacgaacgttatttccaacgttcctacctaacacgtcagacgacgtccgtagacgacggctaggaagtcgttaggtaccgtnttaaggttttacttacgtggtactaagtacctaaattacgttaactagtaccgtaccgtaccgggatccgtttacctaccggtttccggggaccgggtaacggggtaaccgtaaacggggtcgggtaaacgtaaccggttaacgtaaaaccgggtagtttaccgggg

SEQ ID NO: 271913 - DNA, 737 bp, Homo sapiens
  misc_feature: GYAE6OF01AXXFK.13.39.D06.1.454.CMB.1.raw
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (479)..(479): a, c, t, g, unknown or other
  misc_feature (479)..(479): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggactctcgtgggtcgacccggacggggactatcgtgagtcgaacccgtacgtccgtaccgaacgtccctcccgttgggcttcggtcgttccgtcggtacggggaccgaagggaccgggaccctacctacgtaccgtaacgttcgaacgtaacgtaccgacgtaccgaaggttacgtttacgttttaacaactacgtacctaaacctaaaccgtaaattaaacgtaacctttcgtaagttccgttacggtaaccagacaaacgtaacgacgaccncgacctacganctacgtctactagttcgngactactacgtcggtaccgggactccggtccacggtaactcgtagcggngtacgcggtcggagtacggatcgtacttctctacctacacctacgtacgcacgacgtcgtcgacggtagtacgtacgaggttcgtcggttacgttagttaactttcgtacgtacgtacgtactaacttaagttaacttcgtaaccgtcccgttacgtccgtacgtaccgttccggttaccgggtaccgggtacgggtaaaccggtacggaacgggtaccgtaacggtaaaccgttaacggtaacccgtgggtaaccgg

SEQ ID NO: 271914 - DNA, 821 bp, Homo sapiens
  misc_feature: GYAE6OF01DQJZQ.13.39.D06.1.454.CMB.1.raw
  modified_base (264)..(264): a, c, t, g, unknown or other
  misc_feature (264)..(264): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctcgtggtcgcccgacggggacatcgtgatcgacccagtctccagactccgtggctgtgtctcgtgggcgaggacggccaccatcaactgacaagtccacgcaggtacgttatttagacacgcctaaccgaaanaaacgtaacgtacttacgtagtcttacggtaaccagaccgaacgaaacccgagggaccacgtcccttaccgtaagctacgtcctatacgtttacgcgggactataccttacggtacggtaccggttccggggtaccctcggaaccgttacgttacggaacggttcgggacgtagggtcccggggtttagtaacggggtaaccttaacgtaacgtttaccgaccctttaccctacgtaaccctatacccgagtaccgaacgtcccgaggtaccggacgggtactaacgggaacgtacggttcggttaacggggtaaccttttaaaggttttaaccgtaacggttagtaaccgttaacgaaccggttttaaaaggtttaccttttaacggtaaacccggttttacccctaccgggttaacccggtaaacggttccccgttttaacccgttaccgggggttttacccgggaaacgggggtaacggggttaaacccgggtaaacgggtacgggaaacggttaaggttaaaaccccgggtaaacgttaacggggttaccggg

SEQ ID NO: 271915 - DNA, 847 bp, Homo sapiens
  misc_feature: GYAE6OF01AH5N2.13.39.D06.1.454.CMB.1.raw
  modified_base (248)..(248): a, c, t, g, unknown or other
  misc_feature (248)..(248): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatcgacccagtctccagactccctggctgtcgtctcgtgggcgaggacgggccaccatacaacgtgacaagtccacgccagtagttgttttanacacgcctaccaaacaagtaacgtaactttcttagtcgtttacggtacctagactaacgaaaccgaggaccacgcccttaccgtaagtcctacggtaccttacgttaacgttttaccgtacggggtaccttaacgttaccgtttaacccgggttacccggggttaaaccggttccccccgggggtttaccccgttacgggtaaccccggttaccgtttaccgtaacggggtttacccgggaccggttaaccgggggtacccggggttttaccgggttaaccggggggtaaccctaaacggggtttacctttttacccggaaaccccgttttcccggttaaccccgaaacccgttaccgttacccgtaaaccggtaccgtaacccgggtcccgttacgggaccgtacgggtaccgtaaggaagtacggttcggtagtaccgtttaagttttacgtacgttgtacctacgtaattaagtttacgttaagttaccgttacccgtccggttaccgtacggttccctacgttccgggttaccggtcggggaacgtaacccggaagggttcggaacgtaacgttacccgaaacggttggtacggg

SEQ ID NO: 271916 - DNA, 857 bp, Homo sapiens
  misc_feature: GYAE6OF01BVIRA.13.39.D06.1.454.CMB.1.raw
  modified_base (256)..(256): a, c, t, g, unknown or other
  misc_feature (256)..(256): n is a, c, g, or t
tcagtcacgtactacacgaccggtgctcgatttagtgacatctcgcagttctttgggggctacaacaggcaggcaggggcagcaagatggtgttgcagacccaggtcttcatttctctgtgctctggatctctggtcgcccgacggggacatcgtgatcgacccagtctccagcctcctggctgtgtctcgtggggcgaggacgggccaccactacaactgacgaacgtccacgaccgaggtagttcgtttttaanacacgtcctaaccaaacaaataaacgtaacctttacttaggtaccgttacggtaaccacggaccaaacggtaaaacccgacggaaccaccgtaccctaaccgtaagccgttacgccgttacttaacgttttacggtggtacctacttaccgtacggtacccgggtaacgttccccggggtaccctacggaaccgtacgttacgagggtcggacgtacggggtccggggtacgtacggggaactacggttacgtttcacccgttacccgtaccaaccgtacgtaccgaacgtaccgtaccgggaccgttacggaccggtaacgggtaccgtaagggaaacgggtttacgggtggtttaaccgggttaacgttttaagggtttttaaactttccgggttaagtaccgtaaagttaacccgtttaaaagtttaaccgtttaacgggtttaccctaacccggtttacccgggtagtaaaccccggtttcgttaccccgggttaacgggtttaccccgggggtaacggggtaaaccgggtaaaccgggttaggggtaaccggtaacgtaaacccggtaaacgggttaaacccgaacgggttcgggg

SEQ ID NO: 271917 - DNA, 812 bp, Homo sapiens
  misc_feature: GYAE6OF01AWFD3.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccagtctaccagacctcctggctgtgtctcgtgggcgaggacggcccacactcaatcgactaacgtccgacgacctaggtagttgttttacacgacgaccttaccgaaactaaagtaaacgtaacctttacttaacggtccgttacggtaaccgacgacctaaacggaaaaccgaggaaccgtaccgtaccccttaaccgtaacgccgttcggtacctaaccgttacgtttacggacggtacgtacttaccgttacgggtaacccgggtaaccggggtttccccgggtaccccgtacgtaacccgttagttacccggtaggtaccggaccgtacggggtccgggtttaccggtagggaaaccctaggtttactttcccgaccttacccgtaccgaaccgtaccgtacgaccgcgtacccggtacctcggtacgaccgggttagaacggtaaggtcgttacggagttaccgttaagttttaactaccggtacgtaaccgtagtaacgttaaatttacttaacgttacggttccctaccggttacggtaccgttaccggttaccgttaaccgggtccggggaccggtaaacgggttaccgtaaagggttacggaacgttaaccaaccggtaaaccgggtcgttaacccggg

SEQ ID NO: 271918 - DNA, 807 bp, Homo sapiens
  misc_feature: GYAE6OF01ESL7Y.13.39.D06.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (391)..(391): a, c, t, g, unknown or other
  misc_feature (391)..(391): n is a, c, g, or t
  modified_base (498)..(498): a, c, t, g, unknown or other
  misc_feature (498)..(498): n is a, c, g, or t
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
tcagtcacgtactacacgaccggtgctcgatttagtgacatctcgcagttctttgggggctacaacaggcaggcagggggcaggcaagatggtgttgcagacccaggtcttcatttctctgttcgctactggatctcgtgggtccgaccggaacggggtacagtcggtgaacgtccggaaccctaggtcctaccgaacgcccttccgtggtcctggttctcgttacggngggacggagggaccggccaaccgtagtaccaacgtacgaccgtaagccgaacgacgtaggtacgttttgttaacncacgtactaaaccgtaaanaaacgtacgttactacgtactgttaccgaacgacaccgaagaaaactccgacaccgaccctaggtacngtccgtacttataacggttgacgtaactacggtaccgtacggtacccggggtacgtacccggtctaacggacgttacgacggtcggtgaccgggtagggtaccggtnaaccgggttaagaaaccgtttcctaccgtactacccgtaacgtaccgtgttaaccgacgtcgtaccncggtnaaccgggtcgtaacggtaagacgttacggttcggtactttaacgtttaacggtcccttttaaggaacgtccgtaaagtttaactaaacggtttacttacccgggtaataaccccggttcgggtaaacgggtcctttaacccggtacccggtttaggggaacccggggtaaacgggttaaccggtacgaacggggttaaccaagggttaaaacccacgggtaacgttggggttaaccg

SEQ ID NO: 271919 - DNA, 767 bp, Homo sapiens
  misc_feature: GYAE6OF01BA1QS.13.39.D06.1.454.CMB.1.raw
  modified_base (126)..(126): a, c, t, g, unknown or other
  misc_feature (126)..(126): n is a, c, g, or t
tcagtcacgtactacacgaccggtgctcgatttagtgacatctcgcagttctttgggggctacaacaggcaggcaggggcagcaagatggtgttagcagtacccaggtcttcatttctctgtgctntaggatctctggtcgcccgacggggacagtcgtgactcggacccagtcctccagacctcccgtggctgtcgtctcgtgggacgtggacggccacgataccaatcgactaaccgccacgacctagtcttagttttacgacagtccctaacctaaagtaaacgtaacgttacccgttttcgttaacggtaccgtttaccgggaacctaggaacccaaacggaaccccgtaacgtaccaccggtcccttaacgtacggtctagccttaaccgttagtttacgcggtactaactccgtaccgggtaacccggtaccgggtcccgttaccgtacggtaccgtacttagacggtcgacgtacgggacggttcgacggtacctacgttacgtcctacccgtccgtactacccgtagtacccgagaccgttccgcggtacgacgtggtaacctgggtaacgttcgggtacggtacgtcttttaacgttacggttccgtagttaacccgtacggttaattaattaccgggtaacttaccgaccggttcctaaccgtacgggttacttcccggtaacggttaccgggtagggaacccggttaggaaacccgggttgaccggttaaaacctcgtaaaccggtggtaaccggg

SEQ ID NO: 271920 - DNA, 682 bp, Homo sapiens
  misc_feature: GYAE6OF01DBWDI.13.39.D06.1.454.CMB.1.raw
  modified_base (168)..(168): a, c, t, g, unknown or other
  misc_feature (168)..(168): n is a, c, g, or t
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (507)..(507): a, c, t, g, unknown or other
  misc_feature (507)..(507): n is a, c, g, or t
  modified_base (535)..(535): a, c, t, g, unknown or other
  misc_feature (535)..(535): n is a, c, g, or t
  modified_base (671)..(671): a, c, t, g, unknown or other
  misc_feature (671)..(671): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttactctggatctctggtgcccgacggggacagtcgtgactcgaacccngtctccagtacctcctggtctgtgtctcgtcgggngacggacgggacccacactacaacgtcggacaacgtaccacgaccgtagtagttagttttaanacagcctacaaacgtaataaacgtaccttcgttacgtcttacggaaccagaaccaaacgaaaccncgggtanaccggtacctacttaagctcgtacttctaacgtttccgaggacctagttacctaacggtccgggaactcccgggtccgtacgtaaccgtacgttaccgagggttactacgggcggtaccggggttcgacggggaacttcgttactttacggacctacgtaccacgttanaccctaggctacgacgacgcggtaacgngtacgagtagtgtacgtagttacttattaccgtgtacctatacctatttaagaacgttctacgtcctaaggccgtataccgtacggttacgggcggtaaacggacggtagtaccggtacaacgaacgttaaaccgngttccggacgg

SEQ ID NO: 271921 - DNA, 691 bp, Homo sapiens
  misc_feature: GYAE6OF01B3XDI.13.39.D06.1.454.CMB.1.raw
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
tcagtcacgtactacacgaccggtgctcgatttagtgacatctcgcagttcgtttgggggctacaacaggcaggcaggggcagcaagatggtgttgcagacccaggtcttcatttctctgttgctcgtggatctctggtgcccgacggggacagtcgtgatcgacccagtctccagacctcccgtggctgtgtctcgtgggcgaggacgggccacgataccaacgtcgacaacgtccagccgagtagttgttttacacacgtcctaccaaactaataaacgtaactttcgtagtcttacggtaccagtacaacgaaaccnggacaccgtcctactagctcgctactagttcgnggactatcgtacgtccggacgtccggtaccngaccgtntacgnggtcgcgaggtcggtgtacggactagtcttcgactcgtaccacgtactacgacgtccacggtccgtacgcgtacggcgtaagtaagtaggttcggtcggtacctttaagtttaccttacggtacgtacgtacggtaacttaatttaacgtttaacgtaccgtttaaccctccggtaccgggtacccgtttaccttaccgggttaccggttaacccggggtcgggttaacgtaaacccggggtaggtttaaccggaagttaacccgtaaaccgggtaaacggttcccggttacggg

SEQ ID NO: 271922 - DNA, 751 bp, Homo sapiens
  misc_feature: GYAE6OF01CTFG7.13.39.D06.1.454.CMB.1.raw
  modified_base (126)..(126): a, c, t, g, unknown or other
  misc_feature (126)..(126): n is a, c, g, or t
  modified_base (361)..(361): a, c, t, g, unknown or other
  misc_feature (361)..(361): n is a, c, g, or t
  modified_base (402)..(402): a, c, t, g, unknown or other
  misc_feature (402)..(402): n is a, c, g, or t
tcagtcacgtactacacgaccggtgctcgatttagtgacatctcgcagttcgtttgggggctacaacaggcaggcaggggcagcaagatggtgttgcagacccaggtcttcatttctctgttgctntggatctcgtggtcgcccgagggacagtcggtgagtcgaccctagtcctacgagtacctcccgtggtcgtggtcgtcgtcggtaggggacgacggacggtacccaacgtataccgaacgtacggactaacgccacggaccgtaagttacgtttacgtttaacaccgactacctaaccaaagtaagttaacggtaccttgtacgcgttaacgacgtacacgaacgaaccgtgaacnccgtacctaccagtctacgacttactagttacggcgtactntaacgtaccggtaccgggtaacgtcccggttcacggtacctagttccgaggtacgcgtacgggtcggtacaacggtatacttcggtacctcctacgacctatacacggtacgacgtcggactacggtaccggtagaaccgtaggtaacggtcgtttacggtaggttaaccttttaaagggttttactaccggggttactaaccggtaattaccgtttaaagtttaccctaggtacccgttaccggtacccgggtactacgttaccggtaacgttccggggaaccgggtacggtacgggtaaacggtaaggtaccggaacgtaacctaacccggtaagggtcgttacggg

SEQ ID NO: 271923 - DNA, 585 bp, Homo sapiens
  misc_feature: GYAE6OF01EMMBU.13.39.D06.1.454.CMB.1.raw
  modified_base (246)..(246): a, c, t, g, unknown or other
  misc_feature (246)..(246): n is a, c, g, or t
  modified_base (374)..(374): a, c, t, g, unknown or other
  misc_feature (374)..(374): n is a, c, g, or t
  modified_base (423)..(423): a, c, t, g, unknown or other
  misc_feature (423)..(423): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctaccagacctccctggctgtgtctcgtgggcgaggacgggaccaccatcaactgacaagtccagccagtagttgttttanacagctaccaacaataagtaacttcttagcttacgacagacaagaaaccaggacacgcctacaagtcgtgactctattacgtggactatactagtaccgggaacgtcccgggtaccctagaacccgtnttacgaggtggcgaggcggtcgtaggactatacttcactcacacatcancacgctagacgagtcagaagtactggtagtactagtttaacgtacgtagacgtagtactaaattagttaacgtacgttccgtaaccgtcgacggtcctaacgttacggttacgggcggtaacgggtaacgaagggtgaacgaataaccgaaagtaacgtcgg

SEQ ID NO: 271924 - DNA, 728 bp, Homo sapiens
  misc_feature: GYAE6OF01AKO65.13.39.D06.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (321)..(321): a, c, t, g, unknown or other
  misc_feature (321)..(321): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatcgacccagtctccagactccctggctgtgtctcgtggcgagcggccacatcaactgcagtccagccagagttattttanacagctaccaanaataagtaacttcttagtcttaggtaccagctagaaccagactacgctaccaagctgcctctaactttacgnggactactacgtacgtaccgggtaacgtccccgggtcctacggacccgtacgtttcgaggtcggaccgtagggtccgggtaccgtcggggtaacagttacgtttccgtaccttaccgtccaacctacgtccgaccgtcgacggtacccgtcgtacgtacgggtagtaacggtaacgtacgtttcgggtaacggttacgtttaacgtttttaccgttaacgttaccggttaccgtaaacgttattaaaccgttttactttaacgtttaaccgttaacccgttaccgttacccggttaccggttccgttacccggttaaccgggttttacccggggacggggttaaccgggaaccggttaagggtacggtaacggtaaccgtaaccggtaaaccgttacggttaccggg

SEQ ID NO: 271925 - DNA, 682 bp, Homo sapiens
  misc_feature: GYAE6OF01D1WQI.13.39.D06.1.454.CMB.1.raw
  modified_base (351)..(351): a, c, t, g, unknown or other
  misc_feature (351)..(351): n is a, c, g, or t
  modified_base (416)..(416): a, c, t, g, unknown or other
  misc_feature (416)..(416): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (506)..(506): a, c, t, g, unknown or other
  misc_feature (506)..(506): n is a, c, g, or t
  modified_base (555)..(555): a, c, t, g, unknown or other
  misc_feature (555)..(555): n is a, c, g, or t
  modified_base (647)..(647): a, c, t, g, unknown or other
  misc_feature (647)..(647): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctcgtggtcgcccgacgggacatacgtgaatcgacctagtcctcgaagcctccgtggctgtcgtcctgtagggcaggacggtcccaccatccaacgtgactaacgtccacgcctagtacgtttagtttaacacgagccttaacaaacgtaataacgttacttcgtagttctacggtaccagtacaacgtaacaggactacgccttaccaagtctcgacttntactttagcggatacgtacttaccggaccggtaacgtccccgggtactacgaacgttgttaccgnggtacggtccggagggtcccggttagacggtaacttacgttatttacccgtacgtccttacgaaccgttnaaccgngtacacgtgtccgnggtacgtgtaagacgttgtacgttggtaacttagtttaactatcggtanaacttagtaattacgtacgttaccgcccgtaacgtcggacttccgtaaccggttacgttcgggaacgggtaacggttacccggtaaagggtntaaacccgttaacgaaaccgggacgttagtccggg

SEQ ID NO: 271926 - DNA, 873 bp, Homo sapiens
  misc_feature: GYAE6OF01AK2B2.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctcgtggactctctgggtcgacccgacggggtacctagtcgtcgtagtccgtaccccgacgttcctacccaacggaccttccccgtggtccttggttcgtccgttcggtcggggaccggagggtacgggacccaaccgtacttaccaaccgttggacctaacgtccgacgcccgaaggttagttacgttttactaccgacgtacctaacccgaaaacgtaaagtaaacgtaaccgtttaccttaaggttaccgttaccggtaaccgtaagacccgaaacggaaaacccgtcggaaaccgtaccgtaccccgttaaccgtaaaccgtgttaccgtaccgtttacttaaccgtttacggtcggtaccttacgttaccgtacgggtaccccgggtaaccggttccccgggtaccctaccggtacgtaccgttacgacggttaccgggacgtacggggtccgggttaggtaccgggtaataccggtttaccttaactacccgtacctaccgtacctactacggacgaccgtacgtccgtacgtaccgacggttgaacgtaaccggtgttacggtacgggtttaaccttacggttttacgtaacgttcgaaacggttattaaccgttaacttacgtttaaccggtaccgttacccggttaccgtaccgtagtcccgttaccgggttccgggtacgggaacggttaccgtaacggacggtacgtacgtaaccgtaaacgtaaccggttcgtaccggg

SEQ ID NO: 271927 - DNA, 943 bp, Homo sapiens
  misc_feature: GYAE6OF01EBAQO.13.39.D06.1.454.CMB.1.raw
tcagtcacgtactacacgaccggtgctcgatttagtgacatctcgcagttcgtttgggggctacaacaggcaggcaggggcagcaagatgtgttgcagacccaggtcttcatttctctgttgctctggatctcgtggtcgccgacgggacagtcgtgatcgaccagtctcagactccgtggtctgtgtcgtcgtgggcgaggacgggccacactacaacgtcggaccgtaacgtccgacgaccgaaggtacgttttagttttacgaaccacgtactaacccaaaacgtaagttaaacgttaacctttacgtttacggtaccggttttacggtaaaccctacggaaccgaaacggtaaaaccggaacggtaaccgacggttacccttaaccgtaacggtccgttacggtaccgtacgttaacgtttaccggtgggtactaccgttacgtacggtaccgggttaaccgggtccccgggttactacgggtacgtacgttgaacggtacggacgagggtccgggtcgttacgggaacttacggtactttaccgtaccgtccttaccgaacctcgtaaccgcgttaaccgacggtcccgttaacgggcgttaacggtacgttaacgggtaacggttacggtttaacgggttaccggtttaagtttaacggtttttaaccgtttaggttaccgttaacgttacgtaaacgttttaaaacgtttaaccgtttaacgtttaacccggttaccccgttaaccgggttacccgggtaccgggttttaccgttaaccccgggttttaacccgggggtttttaccccgggggaaacgggggttaaaaccccgggggttaaacccggggttaaaaccggggtcgggtttaaaaaacccgggtaaacccggttaaaaaccgggttaaaccccgggtaacggtttaaaccccgggggg

SEQ ID NO: 271928 - DNA, 792 bp, Homo sapiens
  misc_feature: GYAE6OF01A5DJW.13.39.D06.1.454.CMB.1.raw
  modified_base (204)..(204): a, c, t, g, unknown or other
  misc_feature (204)..(204): n is a, c, g, or t
tcagtcacgtactacacgaccggtgctcgatttagtgacatctcgcagttctttgggggctacaacaggcaggcaggggcagcaagatggtgttgcagacccaggtcttcagtttctctgttgctctggatctcgtggtcgcccgacggggacagtcgtagatcgaccagtcctacgagcctccgtggctgtgtcgtcgtgggngagacggccactatacaacgtgacgtaacgtccgagccgtaagtagtttcgtttaacacgtacgtacctaaccgaaaactaagttaaacgtaccttacggttagtccgttaacgtacaagaacgaacgtaaaccgaggtaccgagtaccccttacgtaaacgtccgtatactttactaacgtttacggtacgtacctaacgttccgttaaaccgggacccggtttaaccggggtccccggttacgtaaccggtaacggttactaccggtagggttacccgcgggtacggtcccgggttacgtaacggaacgtttacgtaacgttcacccgttctaaccgaacctacgtacgaccggacgtaccgtcgtaccggacgtacggtaacctagggtaacgtaaggttcggtaaccggttatttacgggtttacttaaccgtacgggtactaaaccggttacttaaacttacggtttaaccgtacggttccctaaccggtaccggttacccgtaacgtttcccgtaacggggttcgggaaaccggtaacgggtaacgtacgggtgtaaaccacgtaacgtaagtaacgggtcg

SEQ ID NO: 271929 - DNA, 803 bp, Homo sapiens
  misc_feature: GYAE6OF01C8HGW.13.39.D06.1.454.CMB.1.raw
  modified_base (138)..(138): a, c, t, g, unknown or other
  misc_feature (138)..(138): n is a, c, g, or t
  modified_base (146)..(146): a, c, t, g, unknown or other
  misc_feature (146)..(146): n is a, c, g, or t
tcagtcacgtactacacgaccggtgctcgatttagtgacatctcgcagttctttggggctgggcctcagggaagcagcatcggaggtgcctcagccatggcatggactccctctcttccgtcggcgtccttgcttacngcacaggntccgtgcctctatgagctcgactcacgccctaccctcgagtcgttccgtacgtccccaagggaccacgacagcccagtccaactccaccgtgcctacttaagggaaaattaaagttggacaaagtaaataataacttacttaccgttaggtactacagacaagtaagacgaccggactacgtcccctagtcgcgtacgtactattctaatacgaaagcgtagacccgaacggccggacccttacggacggttacctacccgtaggacgtaacgttaacgttccgttccgtacgggtaccctaaacccggtaaaccggttaccggggaaacctcccgggacccaaccccgtaccgaacctacgtaacaaacgaccggaaccgaaccggaacggggtaacgggtacgtacggacgggtaccgttagttaacgttaacgttaacgttcggtaacgttaccggggttaggtaaccggggaacggaccggtaacccgtaacccgggtaaggttacggttaacgttaaccggggttcccggggaccgggtaacccggggtaaaccaacggggtaccctaaacgggtaacccccggttacggtaaccgggtaccgaaacccggtacccggaaaccggttccccgtaaccccggttaccccccgg

SEQ ID NO: 271930 - DNA, 735 bp, Homo sapiens
  misc_feature: GYAE6OF01EGWK3.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggactatcgtgatcgacccagtcctccacgacctcctggctgtcgtctcgtgggcgaggacggccacacgtacactcgactacgccacgccagtagttagttttatacgactaccgaaccaaactaaagtaacgtaacttacgttacgtcgttacggaaccgaagaacgtaaacgaaaaccgacggaaccacggtaccctacgtaacgacgtcgtacttcgttacttacgtcggtactacgttacgtacggtaccggtaaccggtcccgggtacctacgtacccgtagttacgacggtcggacgacggggtacggtccggttaacggaaccgttagttacccttacctaaccgttcctaaccgtaactaccgtacgaacggttaccgaccggtccgtacggaaccggtaggttacgaaacggtaacggtcggttacggttaacggttactttaacgttttacgtacgtgtaaccgaagtttacctaaggtttaactacgttacgtaccgaccgtacgtcggtacgtaccggttaggtaccgggaggtacccggtaaggagtacgtaacgaataccggaagttggacgg

SEQ ID NO: 271931 - DNA, 725 bp, Homo sapiens
  misc_feature: GYAE6OF01BY19I.13.39.D06.1.454.CMB.1.raw
  modified_base (578)..(578): a, c, t, g, unknown or other
  misc_feature (578)..(578): n is a, c, g, or t
tcagtcacgtactacacgaccggtgctcgattttagtgacatctcgcagtttctttgggggctacaacaggcaggcaggggcagcaagatggtgttgcagacccaggtcttcattttctctgttgctctggatctcgtggtcgacccgacgggactagtcgtgatcgacctcgtcctaccgacgtaccgttcccgtggtccttcggttcgttccgtcggttacggggacggacggaccggacccaaccgtactaccgaacgtgaccgtacgtaccgacggaccgtaggttacgttttagtttacgtaccacgtacctaaccaaacgtaagttaaacgttaacctttcgttaacgtccggtttaacgaaccacgtaaccgaaacggaaacccgaggacgccgtacccgtacgtaacgtcacgttacctactacgtttcgtacggacttaacgtcgaaccggtcgggaccgttccggctacgtacgtacgtcgtaggccgtagcgggtacggtacgtacgaacttagtccttacgctccgtactacgtacgacgtacgcacggttcgacgacgtacggtnagtaacgtgtcgtacgttattacgttctacgtacgtagtactattagttacgtagttacccgacttcggtaacctacggtcgttaaccggtacggtcggaccggaacgtaggacgggcgttaacgaacgttaaccgaggtcggttcg

SEQ ID NO: 271932 - DNA, 892 bp, Homo sapiens
  misc_feature: GYAE6OF01EE2RV.13.39.D06.1.454.CMB.1.raw
tcagtcacgtactacacgaccggtgctcgatttagtgacatctcgcagttctttgggggctacaacaggcaggcaggggcagacaagatggtgttgcagacccaggtcttcatttctctgttgctctggatctctggtcgcccgacgggacatcgtgactcgacccagtctccagacctccgtggctgtcgtctcgtcgggcgaggacggaccacgataccaactcgacgtaacgtccagtaccgagttagttacgttttaactactagaccgtaaccaaacgtaaacgtaaacgtaacctttcgttacgtcgtttacggtaaccagtaccgaaacgaaacccgtaggaccaacgttcccgtaccgtacgctcgtccttactacgttttacgaggtacctacgttaccgttaacgggtaccggtaaccggtttccccggtaccgttacggtaaccgttacgttccggaaggttcgggtacgtacggggtaccggggtcgtacggaacgtacgtttaaccgtttaccgaactttcccgtaaccaacgtactacccgaacgtcgtaaccggtccgtacggtaccgggtacgtaacggtaacggtaaagggttcgtttaacgggttcgggttaaagttttaccgtttttaaacggttaccgtacggttaaccggtaaacgtttaacgttaaaacgttttacggtttaaaccggttacccggttaaccccgtttaacccggtacccgggttaccgttacccggtttaaccgggtttaacccggtttaccggggggtaaacggggtaaaacccggggttaccgttaaaacgggggttcccgggaaaaaccttaaaccgggtttaaacccccggaaagggtttcccggtaaacccggg

SEQ ID NO: 271933 - DNA, 852 bp, Homo sapiens
  misc_feature: GYAE6OF01B1C0T.13.39.D06.1.454.CMB.1.raw
tcagtcacgtactacacgaccggtgctcgatttagtgacatctcgcagttctttgggggctacaacaggcaggcaggggcaggcaagatggtgttgcagacccaggtcttcatttctctgttgctctggatctcgtggtcgcccgaggggactacgtcgtgatcgacccagtcctccagtacctcccgtggctcgtcgtctcgtgggcgaggacgggcccactatacgaactcggctaacgtccacgaccgtaggtagttgtttaatacgacgtcctaacccaaagtaaacgttaaacgtaaacctttcgttaacgtcgtttaacggtaaccaacgaccgaaacgaaaccgacggtaacaccggtaccctaccgtaaacgtcgttacgtaccttactaacgtttaccggtcggtcttaacgttccgttaaccgggtacccgggtaaccgggtccccgggttacccgtacggttaacccggtaagtttacggtacggtcggtaccggtccggggtaccggggttacgtacggggtaaaccttaaggtttaaccttacccttaacccgtaccgtaccctaaccgaaccgtttaccggaggtaccccgtaacgtcccggtaggaacccggtacgggtacccgtaagggtaacctttagggttaccggttacggttaacgtttaacttttacgttacgttacggtaactacgtaagtttaaaccttagttaaccgtaccgtttaccccgtagggtaccccggttaacggtcccgtttaccgtttacggggaccgggtacggggtaacgtaaccgggtaggtacggtaacaaacggtacgtaaacgtcggttacggg

SEQ ID NO: 271934 - DNA, 955 bp, Homo sapiens
  misc_feature: GYAE6OF01CGGX3.13.39.D06.1.454.CMB.1.raw
tcagtcacgtactacacgaccggtgctcgatttagtgacatctcgcagttctttggggggctacaacaggcaggcaggggcagcaagatggtgttgcagacccaggtcttctatttctctgttgctctggactcctctggtcgcccgtacggggacagtcgtgacgtacgaaccctagtcctccgaacgtacctcccgtgggtcttcggttcgtccgttccggtagggggaccggtaagggaccggggcccaacctacgttaaccaaaaccgttggacctaaaccggtcccaacggacccgtaaggttaggttttaggtttttaaccacgtacggtaccttaaccgaaaacgtaaaataaacggttaaccttttacggttacgttaccgttacggttaaccgaacggaactaaaccgggaaaaccgaacgggtaacctaccgaacccgtttaaccggtacggtacccttacgtacccttaacgttacgttttacgggaccgggtactaacggttaccgttaaccgggtaccggggtaaacccgggtcccgggttaccctaacgggtaaccctcggttaccggtaggtccgggtaacggtcgggtacccgggggttctaacgggggaacttacggttaccttttaccggaccttccgtaaaccgaccccttacgtaacccgtaacggtaccgtaaccgggacctacgggtaaccggtacgggtaccgaagggttaaacggtacgggtttacgtaacgggtttacgtttaacggtttttaaccgttacggttacggtacggttaacggtaacgttaacgtaacgttaacggtttaaaacttcccggtaccttaccggtaccgttaaccggtaacccgggtaccgtaaaccggaaccgggtaccaaacgggttacgtaacggtaaacgttaaaggttaaaccggtgtaacggtaccgg

SEQ ID NO: 271935 - DNA, 723 bp, Homo sapiens
  misc_feature: GYAE6OF01DJPE3.13.39.D06.1.454.CMB.1.raw
  modified_base (125)..(125): a, c, t, g, unknown or other
  misc_feature (125)..(125): n is a, c, g, or t
  modified_base (265)..(265): a, c, t, g, unknown or other
  misc_feature (265)..(265): n is a, c, g, or t
  modified_base (555)..(555): a, c, t, g, unknown or other
  misc_feature (555)..(555): n is a, c, g, or t
  modified_base (698)..(698): a, c, t, g, unknown or other
  misc_feature (698)..(698): n is a, c, g, or t
tcagtcacgtactacacgaccggtgctcgatttagtgacatctcgcagttctttggggagctacaacaggcaggcaggggcagcaagatggtgttgcagacccaggtcttcatttctctgtgctntggatctctggtcgcccgacggggacagtcgtgatcgacccagtcctccagacctcccgtggtctgtcgtctcgtgggcgagacggtccacctagtaccgaactcgacacgtaccagtaccgagttaggttacgttttanacgacgtacctaccaaaactaactaaacgttaactttcgttacgtcgtttacggtaaccaacggacaaacggaaaccgaacgggaactacggtacccttaccgaacgtcgtacgtctacgttacgtttacgtcgggtacacgttacgtacgtaccgggtaacggttcccggggtccttacgacgttagtcgtacggcggacggtgggtacggtcggtaggaccgtaggtttacttacctacgtcctaacctactactacgcgtacgtacgtccgcgacgtacggtaacgnggtaaacgtgttccggtaggttagtttaaaccgtttcttaggtacgttagaacgttaacttaacttagttacgtacttaccgtacccgtacgtaccgttacgtaccgttcggtacggaccggaaccggtaacgtacgggttanaaacggtacaacggtacgttacggg

SEQ ID NO: 271936 - DNA, 760 bp, Homo sapiens
  misc_feature: GYAE6OF01BICDW.13.39.D06.1.454.CMB.1.raw
  modified_base (513)..(513): a, c, t, g, unknown or other
  misc_feature (513)..(513): n is a, c, g, or t
  modified_base (554)..(554): a, c, t, g, unknown or other
  misc_feature (554)..(554): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatcgacccagtctccagacctccgtggctgtgtctcgtgggcgaggacgggccacgatcaacgtgactaacgtccgagcctaggtagtttagttttacaccgacgtacctaccaaactaaagtaacgtaacctttcgttacgtccgtttacggtaaccgacgaccgtaaacgaaaaccgacgggaaccgaccgtaccccttaacgtaacgtccgtcgtacctcgttaacgttttacgtcgggaaccttagtaccgtacggtacccggggtaaccggttcccggggttaccctacgtacgtacgttacggcgtacgggacgacgggtccgggtacggaggtaaccgagttcgttaccncgttacctaccactactcgacgtccgactcccgtgtaccgngtaccgtaggaattcggcgttagtacgtttaagttaacgttcgtacctagtaccgtattaaacttacgttaacgtaccgtaccgtacgttcccgaaggttcccgtcggttttaacccgggacgggggtaacggaacccggggttaacgttaaacggggtacggtaaccgtaaacccggtaaacggtaaacggttacggtcccgggg

SEQ ID NO: 271937 - DNA, 833 bp, Homo sapiens
  misc_feature: GYAE6OF01A0QZ7.13.39.D06.1.454.CMB.1.raw
  modified_base (407)..(407): a, c, t, g, unknown or other
  misc_feature (407)..(407): n is a, c, g, or t
tcagtcacgtactacacgaccggtgctcgatttagtgacatctcgcagttctttgggggctacaacaggcaggcaggggcagcaagatggtgttgcaagacccaggtcttctatttctcttggttcactcgtaggtacttctcgtcggaccgtacccggacgggactacgtcgtacgacgtaccgaaccctcgtacctaccgaccgtaccctccggtcgtcgttcggttccgtcggtcggtcggggaacggacgggacccgacctacctacgttaaccacgtaccgaacctaccgaccgacgacgttaagttcgtttactacgacgacctaaccgaaacttaaataaacgttaccttacgtttacggtacgtaccgtaacaaccggaactaaaccgaacggaaaccncggttaccctacggtaccctaggtacactacggttaccttacgttacggttcgagttaaccttaccggcgggtaacccggttcccggtaccgtccgtaacgtagtaccgtggcggtaggcgggtacggtacggtacgggaaacgtcttaactaccgttcctaccctacgtccgtaccgtactaccgtacgcgacgtaccggacgtacggtacgtacggtagtacggtacggtttacgttaccgttacgttacgttactaccgtacgtattaaccgttaacttacgttaccttacgtaccgttcccgttaccggtaccgttaccggttaccggtacgggttaccggaaccggggttaacggttaccgggaacgttaaccggtaacgtaaacggttaccgtaaacccggtcgtcggttacgtaaccgg

SEQ ID NO: 271938 - DNA, 901 bp, Homo sapiens
  misc_feature: GYAE6OF01BDNVY.13.39.D06.1.454.CMB.1.raw
  modified_base (224)..(224): a, c, t, g, unknown or other
  misc_feature (224)..(224): n is a, c, g, or t
tcagtcacgtactacacgaccggtgctcgatttagtgacatctcgcagttctttggggagcttcagctgtgtagagaagacaggattcaggacaatctccagcatcggccggcttccctctctcctcaccctctcactcactgtgcgaggtccgtggccctagtctgtcgtctcgacctcgacgccctaccgtcgacgtccgttccgaccggggaccccccggngacgggtaaccgggtaccacctacttcttccgttttacggttacgtacgggaacgtccgaacggtaccctaaaccgaacgtaacgttaacggttaaaagtttaatttacgttagttaacttaggtttacggtaacgtactacgcgtaacgtcccgtaacccggaacggtaaaccccgaaccccaaagtcgtacctactaacgttacctaagtaacggtaaatacgtacgaccggtccggtacccgtccgggtaacggttcccctaggacccgtttactacgtttccgtaacggccttaccgaaacgttccgtaccgacctaccgtacctacccggtcccttaccggttcgaacttacggtacgtacggtaccgggtccgtacccgggttgaacggttagtacgggtcgtttacttaacgtttaccttttaacggtcctttaacgggcctaacgtaacgttaaccgggggagggtttaacgggaccttaacgggtaactccccggttaagggtagggtttaacccggggttccggggggttttaacccgtttacgggacccggggggtttaaacccgggaaccgggtttaacccgggaagtttaccccgggggttaaaccctacccgggttttaccccgggtaaaaggtccccccccggtaaagggttaaacccccgg

SEQ ID NO: 271939 - DNA, 818 bp, Homo sapiens
  misc_feature: GYAE6OF01BAZXI.13.39.D06.1.454.CMB.1.raw
  modified_base (799)..(799): a, c, t, g, unknown or other
  misc_feature (799)..(799): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctcgtggtcgcccgacggggactagtcgtgatcgaccctacgtcctccgacgtacctcccgtggtctggttcgtctcggtggggcgacggacggccaaccgtataccgaactgacgaacgtccgagtaccgaggttacgttttacgttttaacgactacgtacccttaacaaaacgtaaagttaaaccggttacctttacttaacggtccgtttacgggaaccgacgaaccgtaaaacgaaaccggtaacgaccaaccggtaccctaacgaacgtcgtacgccttaagttaacgtttcgacgggtacctacttaccgttaacgggaccgggttaccgtaccccgggtacgtacggtaccgttacgttcgaacgggtcgaccggtaacggggtccggtaacggtacgggtcttaacggttacctttccgaccgttacgtacccaaccgtacgttaccgggacgtccgtaacggtacccgttagggtaccgtacggtacgttaaaccgggaaggttacggtaaccggggtttcgttaaacgttttaaccggtttaacttaaccgggtccgaacctttaaggtaccttaattacgtaccgttacgtacccgtccgtacggtctaccggttacgttcggaacgggccggtagaaccgtgggtaacaccgtaanaacgaaccggtgtaccggg

SEQ ID NO: 271940 - DNA, 493 bp, Homo sapiens
  misc_feature: GYAE6OF02G5WIZ.13.39.D06.1.454.CMB.1.raw
  modified_base (437)..(437): a, c, t, g, unknown or other
  misc_feature (437)..(437): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcggtctgggacagatttcactctcacatcagcagcctgcaggctgagatgtggcagtttatactgtcagcaatattanagtactcctccgaggtctcactttcggcgagggccaaggtgaggatcaacgtaacg

SEQ ID NO: 271941 - DNA, 501 bp, Homo sapiens
  misc_feature: GYAE6OF02HKOEY.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgtagctgaagatgtgcagtttattactgtcagcaagtattatagtactcctcgagctcgactttcggcggtaggaccgaaggtggagatacaaacgactgtacgg

SEQ ID NO: 271942 - DNA, 484 bp, Homo sapiens
  misc_feature: GYAE6OF02H6XTY.13.39.D06.1.454.CMB.1.raw
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
tcagtcacgtactacacgaccggtgctcgatttagtgacatctcgcagttctttggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaaagctgctcatttactgggcatctatccgggaatccgggtccctgaccgattcagtggcagcggtctgggacagatttcactctcaccatcagcagcctgcaggctgaagatgtggcagtttatactgtcagcaatattangtacnctcgaggctcactttgcggaggccaaggtgagatcaacgatg

SEQ ID NO: 271943 - DNA, 522 bp, Homo sapiens
  misc_feature: GYAE6OF02H5ITD.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctacctaagctgctcatttactggacatctagtccggaatcccgggtcctgaccgattcagtggcaggcggtcgtgggacagtactttcactctccacctatcagcacgcctgacacggctagaagatggtggactagtttattacgtgtacagtactaatattatagttactcctcgagtctctacgttcggacggtaggaccgtaggtaggagagtacgaacgtatcgg

SEQ ID NO: 271944 - DNA, 503 bp, Homo sapiens
  misc_feature: GYAE6OF02F40E7.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctcgaggctcactttcggacggtaggaccaaggtcggagacgtacgaacgtaacg

SEQ ID NO: 271945 - DNA, 499 bp, Homo sapiens
  misc_feature: GYAE6OF02IUKAP.13.39.D06.1.454.CMB.1.raw
  modified_base (236)..(236): a, c, t, g, unknown or other
  misc_feature (236)..(236): n is a, c, g, or t
  modified_base (457)..(457): a, c, t, g, unknown or other
  misc_feature (457)..(457): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagatgtggctagtttattactgtcagcaattattatagtactcctcgagtctntacctttcggcggtaggaccaaggtggagatacaacgatcgg

SEQ ID NO: 271946 - DNA, 529 bp, Homo sapiens
  misc_feature: GYAE6OF02ITDT7.13.39.D06.1.454.CMB.1.raw
  modified_base (237)..(237): a, c, t, g, unknown or other
  misc_feature (237)..(237): n is a, c, g, or t
  modified_base (311)..(311): a, c, t, g, unknown or other
  misc_feature (311)..(311): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctcaaacaataagaacttctagcttggtaccagcagaaaccaggacagcctcctaagctgctcatttacnggcatctatccgggaatcccggggtcctgaccgatttcagtggcaggcggtctgggacagtatttcgactctcaccatcagcagcctgcaggctagaagntgnggctaagtttatacgtagtcagctaaagtattaatagtaacctccgtaccggtagtccttactacggttcggacggtaacggaccgtaaggtcgaaggtactacgaacgtaacgg

SEQ ID NO: 271947 - DNA, 500 bp, Homo sapiens
  misc_feature: GYAE6OF02JBYO0.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtacccagcagaaaccaggacagcctcctaagctgctcatttactgggcatctatccgggaatccgggtccctgaccgattcagtggcagcgggtctgggacagatttcgactctcaccatcagcagcctgcaggctgaagatgtggctagtttattactgtcagctaatattatagtactcctcgagctctacttcggacggtaggaccgaggtggagatacaacgactgg

SEQ ID NO: 271948 - DNA, 489 bp, Homo sapiens
  misc_feature: GYAE6OF02JCHYF.13.39.D06.1.454.CMB.1.raw
  modified_base (236)..(236): a, c, t, g, unknown or other
  misc_feature (236)..(236): n is a, c, g, or t
tcagtcacgtactacacgaccggtgctcgatttagtgacatctcgcagttctttggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactggcatctatccgggaatccgggtcctgaccgattcagtggcagcggtctgggacagatttcactctcacatcagcagcctgcaggctgaagatgtgctagtttatactgtcagcaatatatagtactcctcgagctctactttcggcgtacggaccaggtggagatacaacgactcgg

SEQ ID NO: 271949 - DNA, 497 bp, Homo sapiens
  misc_feature: GYAE6OF02HLU4V.13.39.D06.1.454.CMB.1.raw
  modified_base (407)..(407): a, c, t, g, unknown or other
  misc_feature (407)..(407): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagntgtggcagtttattactgtcagctaatattatagtactcctcgaggcctcactttcggcgagggaccaaggtggagagtacaacgactgg

SEQ ID NO: 271950 - DNA, 488 bp, Homo sapiens
  misc_feature: GYAE6OF02IJV4N.13.39.D06.1.454.CMB.1.raw
tcagtcacgtactacacgaccggtgctcgatttagtgacatctcgcagttctttggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctctaagctgctcatttactgggcatctatccggaatccgggtccctgaccgattcagtggcagcgggtctgggacagatttcactctcaccatcagcagcctgcaggctgagatgtggcagtttattacgtgtcagcaatatatagtactctcgagctcactttcggcggaggaccaaggtggagatcgaacgatagg

SEQ ID NO: 271951 - DNA, 527 bp, Homo sapiens
  misc_feature: GYAE6OF02GD2HA.13.39.D06.1.454.CMB.1.raw
  modified_base (236)..(236): a, c, t, g, unknown or other
  misc_feature (236)..(236): n is a, c, g, or t
  modified_base (314)..(314): a, c, t, g, unknown or other
  misc_feature (314)..(314): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtacccagcacgaaaccaggacacgcctcctaagctgctcatttacnggcatctatccgggaatccgggtccctgaccgtattcagtggcaggcggtctgggacagtattcactctcaccatcancacgcctgcnggctagaagntgtgctagtttatacgttgtacagtactaattattagttagtacctcctcgagtccttcctacgtttccgggacggtacgggtaccgaagggtcggagatacgaacgtacgtcgg

SEQ ID NO: 271952 - DNA, 495 bp, Homo sapiens
  misc_feature: GYAE6OF02HB478.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatatatagtactcctcgaggctcactttcggcgagggaccaggtggagatacaacgactagg

SEQ ID NO: 271953 - DNA, 496 bp, Homo sapiens
  misc_feature: GYAE6OF02HYYQU.13.39.D06.1.454.CMB.1.raw
  modified_base (403)..(403): a, c, t, g, unknown or other
  misc_feature (403)..(403): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccgggtcctgaccgattcagtgcagcggtctgggacagatttcactctcaccatcagcagcctgcagctgaagntgtggctagtttattactgtcagcaattattatagtactcctcgagctctacctttggcggacggactaagggtcgagatacgaacgatacgg

SEQ ID NO: 271954 - DNA, 609 bp, Homo sapiens
  misc_feature: GYAE6OF02J3NWP.13.39.D06.1.454.CMB.1.raw
  modified_base (333)..(333): a, c, t, g, unknown or other
  misc_feature (333)..(333): n is a, c, g, or t
  modified_base (465)..(465): a, c, t, g, unknown or other
  misc_feature (465)..(465): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtcctccagacctccctggctgtgtctctgggcgagacgggccaccatcaactgcaagtccagccagtagttgttttacacacgctaccaacaataacgaacttcttaagcttaggtaaccagacaacgaaaccaggacacgcctacctaagctagctactaatttacgngggactaacgtcgtacgtaccgggtaactcccgggtcctcgacccgtattcgaggtcggcacggtcgggtctagggacagtacttccactccgtacacatcagtccacgtcctgcgtaggtctagaaacgtntcggtagtcttaagttttactacgtacgtaccgagtacttaagtactttaacgtacgtacctccgtacgacgtactaccgtacgttacggaccgggtaacggaccggaaggttacggaacgtacgtaaccgtaacgtagttcgg

SEQ ID NO: 271955 - DNA, 507 bp, Homo sapiens
  misc_feature: GYAE6OF02IUDEM.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccgggtccctgaccgattcagtggcagcggtctgggacagatttcactctcaccatcagcagcctgcaggctgaagatgtggctagtttattacgtgtcagcaatattatagtactcctcgagtctctactttcggacggtagggaccaagggtggaagtagtacaacggactacggg

SEQ ID NO: 271956 - DNA, 501 bp, Homo sapiens
  misc_feature: GYAE6OF02FNAOP.13.39.D06.1.454.CMB.1.raw
  modified_base (238)..(238): a, c, t, g, unknown or other
  misc_feature (238)..(238): n is a, c, g, or t
  modified_base (487)..(487): a, c, t, g, unknown or other
  misc_feature (487)..(487): n is a, c, g, or t
tcagtcacgtactacacgaccggtgctcgatttagtgacatctcgcagttctttgggggctacaacaggcaggcaggggcagcaagatggtgttgcagacccaggtcttcattttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcattactgggcatctatccgggaatccgggtccctgaccgattcagtggcagcgggtctgggacagatttcactctcaccatcagcagcctgcaggctgaatatgtggctagtttatactgtcagcaattattatagtacctcctcgagtctctacgttcggcggaggaccgaggtggaganacgaacgtatacgg

SEQ ID NO: 271957 - DNA, 646 bp, Homo sapiens
  misc_feature: GYAE6OF02IJ2KD.13.39.D06.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
tcagtcacgtactacacgaccggtgctcgatttagtgacatctcgcagttctttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagtnatgtgtggttatactatgtctctggtaccaacaaaccagcaaagccccaaaancatgattangatgtcagtaacgccggcctacgacgggtcccagtactcgtcttctctcgccctctaacgtcgtggaccaaaccgtaccggcccttcccgtcgaaccctacttcctcgtcgggtccttaccgacggtcccgtaggtaaggtactcggtaacgttccgttggtaacttttaacttacgtcgtccgttacgtcccgttacgtaacgttacttcgggtaaccgacgggtacaacggtacccttaccaacgttcggtttaaccgttaaccgtttccgggggaacggggtacggaaaaccgtaccggtcttaaccgggtaccccgtttaccggttacgggtcctaaccccggg

SEQ ID NO: 271958 - DNA, 525 bp, Homo sapiens
  misc_feature: GYAE6OF02ID7F4.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaaacaataagaacttcttagcttggtacagcagaaaccaggacagcctcctaagctgctcatttactggcatctagtccgggaatcccgggtccctgaccgattcagtggcagcgggtctgggacagtatttcacttctcaccatcagccagcctgcaggctagaagatgtggctagtttatactgtacagtactaatattatagtactcctcgaggtctctaccgtttcggcggtaacggaccgtaagggtcggaagtacgtacgtaacgtacgtcggg

SEQ ID NO: 271959 - DNA, 509 bp, Homo sapiens
  misc_feature: GYAE6OF02GH3ZI.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagatgtggctagtttattactgtcagcaattattatagtactcctccgagcctctactttcggcggtagggaccgaaggtcggagtatacgtaacgacgtacgg

SEQ ID NO: 271960 - DNA, 545 bp, Homo sapiens
  misc_feature: GYAE6OF02I41A1.13.39.D06.1.454.CMB.1.raw
  modified_base (463)..(463): a, c, t, g, unknown or other
  misc_feature (463)..(463): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaacgcccccaaaatcatgatttatgatgtcagtaagcggccctgacggggtccctgatcgcttctctcgcctccaagtctggacaaccgaccggtcctccctgaccaatcctctggacctccgacggcccgaggacgagctgattatactgcgctccgtggactattacgcctaaccttntcgtcgttcgggactgtacgacctaacggtcctaccgttaccgtaggtccacggtcccgaacggacccctaaccccgctacg

SEQ ID NO: 271961 - DNA, 547 bp, Homo sapiens
  misc_feature: GYAE6OF02IKGWU.13.39.D06.1.454.CMB.1.raw
tcagtcacgtactacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacaccggaactggtgatataaactggtaccagcagctcccaggaaccggcccccaaactcctcatctatactaataatcaccggcctcaggactccctgaccgtattctctcgcctacaagtctggcacctcacgcctccctgccatcagtcggctccagtctgagatgagctgattattactgtgcagcatactatcgacctaccctagaagttgggttcgtttggggtgtttccgggacgggtacgggtacccaaggccttacggacccgttccgtaacgggtcaccggaccccgtaacggg

SEQ ID NO: 271962 - DNA, 566 bp, Homo sapiens
  misc_feature: GYAE6OF02I0NKS.13.39.D06.1.454.CMB.1.raw
  modified_base (236)..(236): a, c, t, g, unknown or other
  misc_feature (236)..(236): n is a, c, g, or t
  modified_base (366)..(366): a, c, t, g, unknown or other
  misc_feature (366)..(366): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
tcagtcacgtactacacgaccggtgctcgatttagtgacatctcgcaggttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccacatcaactgcaagtccagccagagtgtttanacagctccaacaataagaacttcttagcttggacccagcagaaaccaggacagcctctaagcctgctcatttactggcatctatccgggaaatccggggccctgaccgatttcagtcggcaggcgggtcngggacaggatttcacttctcaccatcagcagcctgcaggctagaacgntagtggcttagtttaattacgtntacctagtactaaattattaagtacgttaacttcccgtacggaaccggtccttaccgtaaccgtttccgggacgggtaagggtaacccgaaagggttcggaacggacgtaaccgaaacggtacttcggg

SEQ ID NO: 271963 - DNA, 521 bp, Homo sapiens
  misc_feature: GYAE6OF02F6IZI.13.39.D06.1.454.CMB.1.raw
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctacaccatcagcagcctgcaggctgaagntgnggcagtttattactgtcagctaatattaatagtacctcctccgaggtcctcgtacgtttccggacggagggtaaccgaagggtggaagtacgtacgaaacgtaacgg

SEQ ID NO: 271964 - DNA, 507 bp, Homo sapiens
  misc_feature: GYAE6OF02GFBRU.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagatgtggctagtttattactgtcagcaaatattatagtactcctccgaggctctacctttcgggacggtaggaccgaaggtggagatacgaacgagtacgg

SEQ ID NO: 271965 - DNA, 620 bp, Homo sapiens
  misc_feature: GYAE6OF02G06GA.13.39.D06.1.454.CMB.1.raw
  modified_base (252)..(252): a, c, t, g, unknown or other
  misc_feature (252)..(252): n is a, c, g, or t
  modified_base (371)..(371): a, c, t, g, unknown or other
  misc_feature (371)..(371): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatcgacccagtctccagacctcccgtggctgtgtctcgtgggcgaggacgggccaccatcaactgacaacgtccacgccaagtagttagttttaanacacgtcctacccaaactaaataaacgtaacctttacttaacgtcctttacggtaacccaagacaaacgaaaacccgaggaacacgccccttacctaaagctgcctactaattttacgngggactactactaacgtccgggtaaacgttccccgggggtaccctaggacccgtatttcgaaggtcggacgaggtccgggtcgtgggaaccagtactttcactctaccacatcagcacgcctgcgagctagaagagtgtcggacttagtttacttacgtgtacagactaattattagtacgtactccgtacgaggtctacgtacgttacggcggaacggacgtaagggtgaagtactacgaacgtacgg

SEQ ID NO: 271966 - DNA, 504 bp, Homo sapiens
  misc_feature: GYAE6OF02GOEZH.13.39.D06.1.454.CMB.1.raw
  modified_base (237)..(237): a, c, t, g, unknown or other
  misc_feature (237)..(237): n is a, c, g, or t
  modified_base (314)..(314): a, c, t, g, unknown or other
  misc_feature (314)..(314): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcaagaaaccaggacagcctacctaagctgctcatttacngggcatctatccgggaatccggggtccctgaccgattcagtggcagcgggtcgtgggacagtactttcactctcaccatcagcagccngcaggctgaagntgtgctagttattacgtgtcgagcaatatatagtactcgtcgagtctacgtcttcggcggaggaccgaggtggagacgtacgaagtaacg

SEQ ID NO: 271967 - DNA, 505 bp, Homo sapiens
  misc_feature: GYAE6OF02GFPRT.13.39.D06.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
  modified_base (409)..(409): a, c, t, g, unknown or other
  misc_feature (409)..(409): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttacnggcatctatccgggaatcccgggtcctgaccgattcagtggcagcgggtctgggacagatttcactctcaccatcagcagcctgcaggctagaacgntgtgactagtttatacgtgtacagactaatattatagtactcctacgagtctctacttcggccggaggaccgaaggtggagagtacaacgatacgg

SEQ ID NO: 271968 - DNA, 501 bp, Homo sapiens
  misc_feature: GYAE6OF02GY6K8.13.39.D06.1.454.CMB.1.raw
  modified_base (237)..(237): a, c, t, g, unknown or other
  misc_feature (237)..(237): n is a, c, g, or t
  modified_base (421)..(421): a, c, t, g, unknown or other
  misc_feature (421)..(421): n is a, c, g, or t
  modified_base (448)..(448): a, c, t, g, unknown or other
  misc_feature (448)..(448): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtacccagcagaaaccaggacagcctcctaagctgctcatttactgggcatctatccgggaatccggggtccctgaccgattcagtggcagcgggtctgggacagatttcactctcaccatcagcagcctgcaggctgaagatgtgcagtttntactgtcagcaatattatagtactccncgaggctcactttcggcggtagggaccaaggtggagatacgaacgtactacgg

SEQ ID NO: 271969 - DNA, 531 bp, Homo sapiens
  misc_feature: GYAE6OF02H78ON.13.39.D06.1.454.CMB.1.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
tcagtcacgtactacacgaccggtgctcgatttagtgacatctcgcagttctttggggctacaacaggcaggcaggggcagcaagatggtgttgcagaccccaggtcttcatttctctgttgctctggatctctggtgcccacggggacatcgtgatgacccagtctccagactccctggctgtgtctctgggcgagagggccaccatcaactgcaagtccagccagagttgtttanacagctccaacaataagaacttcttagcttggtaccagcagaaaccaggacagcctcctaagctgctcatttacgngggcatctagtccgggaatcccgggtccctgaccgattcagtcggcnggcggtctgggacaggtatttcactctcacctatcagcacgcctgcaggctagaagnttgcggatagtttattacgtgtcagctaaattatatacgtactccgtacgagtctcgtaccgtttcgggccggtaacggaccgagggtcggaagtacgacgtaacgacttcggg

SEQ ID NO: 271970 - DNA, 516 bp, Homo sapiens
  misc_feature: GYAE6OF02FE3TD.13.39.D06.1.454.CMB.1.raw
  modified_base (239)..(239): a, c, t, g, unknown or other
  misc_feature (239)..(239): n is a, c, g, or t
  modified_base (409)..(409): a, c, t, g, unknown or other
  misc_feature (409)..(409): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctccaacaataagaactcttagcttggtaccagcagaaccaggacagcctcctaagctgctcatttactgggcatctatccgggaatccggggtccctgaccgattcagtggcagcgggtctgggacagatttcactctcaccatcagcagcctgcaggctgaagntgtggctagttattactgtcagcaatattatacgtactccgtacgaggtcctctaccgtttcggacggtacgggaccgagggtacggagacgtacgaaacgtaacgg

SEQ ID NO: 271971 - DNA, 712 bp, Homo sapiens
  misc_feature: GYAE6OF02JBY1F.13.39.D06.1.454.CMB.1.raw
  modified_base (213)..(213): a, c, t, g, unknown or other
  misc_feature (213)..(213): n is a, c, g, or t
  modified_base (215)..(215): a, c, t, g, unknown or other
  misc_feature (215)..(215): n is a, c, g, or t
tcagtcacgtactacacgaccggtgctcgatttagtgacatctcgcagttctttgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcactcncncgctgagaaatagtcgacgataataatacttaccttcgtagtactacgacgtacgaagtacgtacgaccggaccgtacccgtcccttaggtcgtcggttcggtactattaccttactaacgaagtatccgaaccgacggccccgtaccctaggaacggtaccctcccggtaggaccggtacgtttactttccgtcggtccggtaccctaaccgttaaccttccggggtaaccggtaaccctcgaaccccggtacccttacgttcccggaacctaacccttacgacccgggacgggggaacccccgtaaccggacggtttactacgggaggttacgacgggtaccgttagtaacctaatttacccgttggtctacgggagttccgggtaagacagtaccgacgtacgttacgcccggcccgttaacttggttacccgttccggtaaaggaccgtccgggtaaaaccgtccggtaaccctacccggtttacgtaaccgg

SEQ ID NO: 271972 - DNA, 724 bp, Homo sapiens
  misc_feature: GYAE6OF02HOKTM.13.39.D06.1.454.CMB.1.raw
  modified_base (242)..(242): a, c, t, g, unknown or other
  misc_feature (242)..(242): n is a, c, g, or t
tcagtcacgtactacacgaccggtgctcgatttagtgacatctcgcagttctttgggggggtctcaggaggcagcactctcgggaccgtctccaccattggcctgggctctgctcctcctcagcctcctcacgtcagggcacaggatccctgggactcagtctgccctgactcagcctcggctcaggtcgtccggtctccgtggacagtcagtcaccatcctcctgcactgaaccagcagtnatgttggtgttataactatgtaactctaggtaccaacaacacccaggccaaacgcccctaaaatccgaagtcgtaatttacgtacgtactcgtactacggtaacgccggtacctcggacggggtccctggacgtcggtacttccgtcgtcgcccttaccaacgttcctacggaccaacgtacccgggtcccttacccgtacgaccctacgttccgtaccgttcgggtaccttcccgagggtaccgttacgggtaaggttacgttcggtaacgtttccgtaagggttaaccttttagttaccgttcggtaccgttacgtcccttacgtaacttacgttaaaccggtaaggcccgggtaacgaccggttcccgttacgttaccgttttaacgtcccgtttacggttacccgggtaacgggttccgggtaacccgtaacgggttccccgtaacccggtttaccttaaccggtccgttaaccccgg

SEQ ID NO: 271973 - DNA, 534 bp, Homo sapiens
  misc_feature: GYAE6OF02IIY7M.13.39.D06.1.454.CMB.1.raw
  modified_base (238)..(238): a, c, t, g, unknown or other
  misc_feature (238)..(238): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctaccaaacaataagaacttcttagcttggtaccagcaagaaaccaggacagcctctaagctgctcatttactggcatctatccggaatccgggtcctgaccgattcagtggcagcgggtctgggacagtactttcactctacaccatcagcagcctgcgaggctagaagatgtgactagtttattacgtcgtacgagtactaattaattatagtactccgtaccgagtctcgtaccgttcgggacggtaacgggaccgtaagggtggaagtacgtaacgaaccgtagtcgg

SEQ ID NO: 271974 - DNA, 656 bp, Homo sapiens
  misc_feature: GYAE6OF02G5AP1.13.39.D06.1.454.CMB.1.raw
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctcttttgctctggatctctggtgcccacggggacatcgtgatgacccagtctccagactccctggctgtgtctctgggcgagagggccaccatcaactgcaagtccagccagagtgttttanacagctaccaacaataacgaacttcttagcttaggtaccagcaagaaaccaggacagcctacctaagctgctactatttacgtggcatctacgtccgggaactcccggggtccctgaccgtattcgagtggcacgcgggtcgtagggactagtactttcgacctctaccgacctatcacgcctagcccgtaggccacgggtctacggaaagtacgttggtagggtcttaaggtttttacttacgttaggttaccgtaaggtaactaaagtttaactttaacgttaaacttaaccgtttacccgttaccggtacggttccttacccgtttaacggttttcccgggaaccggggttaacgggacccggtaagggttacggaacggtaacgttaaccggaaacggttaccgttagggtacgg

SEQ ID NO: 271975 - DNA, 521 bp, Homo sapiens
  misc_feature: GYAE6OF02GG9K9.13.39.D06.1.454.CMB.1.raw
  modified_base (407)..(407): a, c, t, g, unknown or other
  misc_feature (407)..(407): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttctagcttggtaccagcagaaaccaggacagcctctaagctgctcatttactgggcatctatccgggaatccgggtccctgaccgattcagtggcagcgggtctgggacagatttcactctcaccatcagcagcctgcaggctagaagntgtggctagtttatactgtcagctaatattaatagtacctcctcgagccttctaccgtttcgggaccggtacgggaccgtaagggtgggaagtataccgaaacgacgttacggg

SEQ ID NO: 271976 - DNA, 504 bp, Homo sapiens
  misc_feature: GYAE6OF02HV1YA.13.39.D06.1.454.CMB.1.raw
  modified_base (384)..(384): a, c, t, g, unknown or other
  misc_feature (384)..(384): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaaacaataaagaacttcttagcttggtaccagcagaaaaccaggacagcctcctaagctgctcatttactgggcatctatcgggaatccgggtccctgaccgattcagtggcagcgggtctgggacagatttcactctnaccatcagcagcctgcaggctgaagatgtggcagtttattaactgtcagcaaatattatagtactctccgaggctcactttcggcggtagggaccgaaggtggaagatacaaacgatacg

SEQ ID NO: 271977 - DNA, 496 bp, Homo sapiens
  misc_feature: GYAE6OF02GRI82.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgtttatacagctccaacaataagaacttcttagcttggtaccagcagaaaccaggacagcctcctaagctgctcatttactgggcatctatccgggaatcccgggtccctgaccgattcagtggcagcgggtctgggacagatttcactctcaccatcagcagcctgcaggctgaagatgtggctagtttattactgtcagcaatattatagtactcctcgagctctctttcggcgaggacaggtggagatacgaacgtatacgg

SEQ ID NO: 271978 - DNA, 508 bp, Homo sapiens
  misc_feature: GYAE6OF02GPVFI.13.39.D06.1.454.CMB.1.raw
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctgtctgtgtctctgggcgagagggccaccatcaactgcaagtccagccagagtgttttatacagctccaacaataataacttcttagcttggtaccagcaagaaaccaggacagccttctaagctgctcatttacnggcatctatccgggaatccgggtcctgaccgattcagtgcagcgggtctgggacagtactttcactctcaccatcagcagcctgcaggctagaagntgtgntagtttatactgtnagactaatatatagtactctcgagtctcgtacttcgggcggaacgggacctaagggtggacgtaagtacaaacgacgtgg

SEQ ID NO: 271979 - DNA, 501 bp, Homo sapiens
  misc_feature: GYAE6OF02ILRCM.13.39.D06.1.454.CMB.1.raw
  modified_base (236)..(236): a, c, t, g, unknown or other
  misc_feature (236)..(236): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (452)..(452): a, c, t, g, unknown or other
  misc_feature (452)..(452): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaacccaggacagcctcctaagctnctcatttacnggcatctagtccgggaatccgggtccctgaccgattcagtggcaggccggtntgggacagntttcactctcaccatcagcacgcctgcaggctagaacgatgtgctagtttatactgtcagacaatattatagtactccncgagcttcacgttcggacggacggacagggtggagagtacaagactagg

SEQ ID NO: 271980 - DNA, 571 bp, Homo sapiens
  misc_feature: GYAE6OF02JTDUA.13.39.D06.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcagagggccaccatcaactgcaagtccagccagagttgttttanacagctccaacaataagaacttctagcttggtaccagcagaaaccaggaccagcctctaagctgcctactatttacgnggctactctacgtaccgggacgtcccggtcctacgaccgtatacgaggtcgacgtacggtcggtctagggcagtattccactctcgacntacacgtcnctctgctaggtctagagtagtgtcgtattagtttagttccgtagtcgaagtacctaagttagtactacgtccttaccgtcgaacgttctaccgttacggttcgggaaccggacggtaaccgtagggtacggtactacgtaaccgtaacggtcgttagg

SEQ ID NO: 271981 - DNA, 516 bp, Homo sapiens
  misc_feature: GYAE6OF02JSEX6.13.39.D06.1.454.CMB.1.raw
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagacttcttagcttggtaccagcagaaccaggacagcctcctaagctgctcatttacnggcatctatccgggaatccgggtcctgaccgattcagtggcagcgggtcngggacagacttcactgtcacatcagcancctgcaggntganatgnggtcagtttatatgtcagctaatattataacgttactccgtccgagtcctacgtactttcggggccggtaggtacccgtaagggtcggtagagtacgaaaccgacgttacgg

SEQ ID NO: 271982 - DNA, 505 bp, Homo sapiens
  misc_feature: GYAE6OF02IH0J5.13.39.D06.1.454.CMB.1.raw
  modified_base (416)..(416): a, c, t, g, unknown or other
  misc_feature (416)..(416): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctggaataatggcagataaatatacttctggtatcagcagaagtcaaggccagtcccctgtgctggtccatctatcaagatgccaagcggccctcagggatcccctgacgcgaattctctaggctccaactctgggaactcagccactctgaccatcaggccggaccaggctagcggatgaggctgactaatttaccngttcgagggcgtagggacaggcagcacgtcgacccgcttagtcgttccttacggaacgtcgggaacccaagggtcacccgtcctaacgg

SEQ ID NO: 271983 - DNA, 510 bp, Homo sapiens
  misc_feature: GYAE6OF02GR8M3.13.39.D06.1.454.CMB.1.raw
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctctggtaccaacaacacccagcaaagcccccaaaatcatgatttatgatgtacagtaagccggcctcgacggggtccctgatcgcttctctcgcctccaagtctggccaacgacggccctccctgacccatctcgtcgggctccgaggctggaggatgacgtctgatttatactgctgctnattangcagcacgctacacgtgttaactcgttcggacggaggaccaggcgtcggaccgttccgaggtaccg

SEQ ID NO: 271984 - DNA, 580 bp, Homo sapiens
  misc_feature: GYAE6OF02IJRV8.13.39.D06.1.454.CMB.1.raw
  modified_base (343)..(343): a, c, t, g, unknown or other
  misc_feature (343)..(343): n is a, c, g, or t
tcagtcacgtactacacgaccggtgctcgatttagtgacatctcgcagttctttggggagcttcagctgtggtagagaagacaggattcaggacaatctccagcatggccggcttccctctcctcctcaccctctcactcactgtgcagggtcctgggcccagtctgtgctgactcagccaccctcagcgtctgggacccccgggcagagggtcaccatcctcttgttctgaaagcagctccaacaccggactggtgatataaactggtaccagcagcctcccaggaaccggcccccaaactcctcatctaatactaataactccaccgcctcagggctcccngacctattctctggctcaagtctggcacctcacgtccctcccgtggcccatcaggtcgggccttccgggtccgaggatggaggcttgtaatttacttacgtgtgcgagctagtgggataggacgcgtcctggacgttcgggtccggttggttccgggcgggtaacgggaccctaaggtccgttacggacccggttccgtagggttaccaccgggtacccaacgggtcctaccccggg

SEQ ID NO: 271985 - DNA, 506 bp, Homo sapiens
  misc_feature: GYAE6OF02F9SW1.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctcttttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtgcagtttattactgtcagcaattattatagtactcctccgagctctactttcggcggaaggtaccaaggtcggagagtacaaacgactgtacgg

SEQ ID NO: 271986 - DNA, 517 bp, Homo sapiens
  misc_feature: GYAE6OF02HUJOR.13.39.D06.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtacagcagaaaccaggacagcctcctaagctgctcatttacnggcatctagtccgggaatccgggtccctgaccgattcagtggcagcgggtctgggacagatttcactctcaccatcagcagcctgcaggtctagaagacgtgtgacgtagtttacttactgtacagtactaattattatacgtactcctacgagtctctacgtttcggacggtaggaccgaggtggagtatacgaacgtacgtacgg

SEQ ID NO: 271987 - DNA, 573 bp, Homo sapiens
  misc_feature: GYAE6OF02HP9BV.13.39.D06.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccagacagcctcctaagctgctcatttacngggcatctagtccgggaatccgggtccctggaccgattcagtggcagcggtcgtgggcagatttcactctcaccatcgagcagcctggcaggcctgaagtgtgtgcgtagtttaattacttgtacagtactaattaattagtaacgttactaccgtacgtacggtaccttaccggtaccgttttacgggaccgggtaacggggtaacccgtaaggggttacggtaaacggtaaccgtaacgtaaaccggtaaccgttacgggg

SEQ ID NO: 271988 - DNA, 552 bp, Homo sapiens
  misc_feature: GYAE6OF02H9FOK.13.39.D06.1.454.CMB.1.raw
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatntacttctggtancagcagatcaggccacgtcccctgtcgctggtcatctatacaagatgaccaagccggcccttgagggactcccgtgagcgtattctccgtggcccttccaacttcgtacgggtaactcgacgccactctacgacctatcgacgccgggactcgacggtctagtggatagacggtcgtacgtacttacgttacgtcgtacgtaggtcggtaggacgagaccgagccgtacgtcgtacccgtgttacgtcgttccgttacggacggtaccggacgtaacggtacccgtaccgtaccg

SEQ ID NO: 271989 - DNA, 543 bp, Homo sapiens
  misc_feature: GYAE6OF02GKCWZ.13.39.D06.1.454.CMB.1.raw
  modified_base (237)..(237): a, c, t, g, unknown or other
  misc_feature (237)..(237): n is a, c, g, or t
  modified_base (316)..(316): a, c, t, g, unknown or other
  misc_feature (316)..(316): n is a, c, g, or t
  modified_base (425)..(425): a, c, t, g, unknown or other
  misc_feature (425)..(425): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagcctaccaacaataagaacttctagcttaggtaccagcaagaaaccaggacagcctactaagctgctcatttacgnggctatctagtccgggaatcccggggtccctggaccgtattcgaggtcggcgaggcgggtcgtgggacagtactttcactctcaccatcagcagcctgcaggctgaagntgtgcttagtttatacgtgtacagactaatattaagtacgttactccgtcgacgtcgtactaccggtttcgggacggaacggaccgtaaggtcggagtacgtacgtaacgtagtacgg

SEQ ID NO: 271990 - DNA, 615 bp, Homo sapiens
  misc_feature: GYAE6OF02GXW78.13.39.D06.1.454.CMB.1.raw
tcagtcacgtactacacgaccggtgctcgatttagtgacatctcgcagttatttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctggtatcagcagagtcaggccacgtcccctgtcgtcgtggtcatctatacaagactcgaccaacggccggccctacgacgggtactcccgtagacgcgtattccgtcgtcggtacctaccgtaaccttccgtacgggacctcgacgtccctaccgttcctacgtacccacgtacgacggaccgggacccgaggtactacggtacggagtcggacggtctacgtacttaacttacgtacgtacgacgggtacggtagggaccgagacgacggaccacgtccgcccgtcttacgttccgttccgttaaccgggaaccggttaccggggtaaccgtaacgggtacccgtaccggttaccgtaacccgg

SEQ ID NO: 271991 - DNA, 630 bp, Homo sapiens
  misc_feature: GYAE6OF02H3KLP.13.39.D06.1.454.CMB.1.raw
  modified_base (240)..(240): a, c, t, g, unknown or other
  misc_feature (240)..(240): n is a, c, g, or t
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatgacccagtctccagactccctggctgtgtctcgtgggcagagggccaccatcaacgtgacaagtccagccagagttgtttanacagctaccaaacgaataaacgtaacttcttaagccgtttaggtacccagacgtaacgaaaaccaaggaccagacccttacctaagcctgcctacagtttacngggctatcgtagccgggtaagtcccgggtccctaggaccgtatcgtagnggcaggcggttcgagggactagatttcactacgtacaccgtancagacacgtcngtcaggcttagaagtagtcgtagaccgttagtttaacgttacgcgtactaacgacttaaagttaacgttaataacgttacttaccccgtacggtaacggtccctaccggtttaacgttcgggtaccggggtaaacggacccgttaagggtacggacgtaagttaaccgtaaacgaacgttcggg

SEQ ID NO: 271992 - DNA, 543 bp, Homo sapiens
  misc_feature: GYAE6OF02IE7P2.13.39.D06.1.454.CMB.1.raw
  modified_base (286)..(286): a, c, t, g, unknown or other
  misc_feature (286)..(286): n is a, c, g, or t
  modified_base (416)..(416): a, c, t, g, unknown or other
  misc_feature (416)..(416): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctccaaacaataagaacttcttagcttggtaccagcagaaaccnggacagcctcctaagctgctcatttactggctatctatccgggaatcccgggtcctgaccgtatcagtcggacagcggtacgtgggacagtatttcactctcacatcagcagcctgcgaggctagaagtntcgtgactagtttacttacgtgtacagtactaattattatacgtacctctaccggtagactctaccgttcgggacggtaacgggtacccgaagggttcggaacgtagtacgaaacccggtagtacgg

SEQ ID NO: 271993 - DNA, 510 bp, Homo sapiens
  misc_feature: GYAE6OF02GU1BC.13.39.D06.1.454.CMB.1.raw
  modified_base (236)..(236): a, c, t, g, unknown or other
  misc_feature (236)..(236): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttactgggcatctatccgggaatcccggggtccctgaccgattcagtggcaggcgggtctgggacagtattcactctcaccatcagcagcctgcagctgaagagtgtgctagtttattactgtcagactaatattatacgtactcctcgagtcctctactttcggcggtacggacgagggtcggagtactacgtaacgatacgg

SEQ ID NO: 271994 - DNA, 523 bp, Homo sapiens
  misc_feature: GYAE6OF02IHS85.13.39.D06.1.454.CMB.1.raw
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (403)..(403): a, c, t, g, unknown or other
  misc_feature (403)..(403): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcagtccagccagagtgttttatacagctccaacaataagaacttcttancttggtacagcagaaacccaggacagcctcctaagctgctcatttacngggcatctatccgggaatcccgggtccctgaccgtattcgagtcggcagcgggtctgggacagctttcactctcaccatcagcagcctgacnggctgaagatgtgctagtttattactgtacagctaatattaagtactactcctcgagtcctaactacgtttcgggcggtacggtaacctagggtcggaagtacgtacgaacgacttacgg

SEQ ID NO: 271995 - DNA, 527 bp, Homo sapiens
  misc_feature: GYAE6OF02F68Y6.13.39.D06.1.454.CMB.1.raw
  modified_base (237)..(237): a, c, t, g, unknown or other
  misc_feature (237)..(237): n is a, c, g, or t
  modified_base (437)..(437): a, c, t, g, unknown or other
  misc_feature (437)..(437): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctagtccgggaactccgggtccctgaccgattcagtcggcagcgggtctgggacagatttcactctcaccatcagcagccctgcaggctagaagatgtggctagtttacttactgtacngtacaattattattacgtacttcctcgaggtctcgtacgtttcggacggacgggtacgtaaggtggtaagacgtacgtaacgattacggg

SEQ ID NO: 271996 - DNA, 599 bp, Homo sapiens
  misc_feature: GYAE6OF02HHZRL.13.39.D06.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagngggccaccatcaactgcaagtccagccagagtgttttanacagctccaaacaataagaacttcttaagcttaggtaccagcaagaaaccaggacagcctactaagctgctcatttactggcatctatccgggaatcccggggtccctgaccgattcaggttcggcgaggcgggtctgggacaggtactttcactctccgaccatcagcacggccctgaccagggtctaggaagtgtggtaggacttaagttttacttaccgtggtaccagtactaaagttatttaacgtaacgttaccttccctacgggtacgtacctttacgtaccgttttccggggaccggtaacggggtacccgtaagggttacgggaacgtacgtaaccgtaaacgtaccgtacggg

SEQ ID NO: 271997 - DNA, 509 bp, Homo sapiens
  misc_feature: GYAE6OF02FLL74.13.39.D06.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttacngggcatctatccgggatccgggtccctgaccgattcagtcggcaggcgggtcgtgggacaggtatttcgacttctccaccactcacgcagcctgcaggctgaagatgtgctagtttattacgtgtacagctaatattatagtactcctcgagctctacgttcggacggaggaccgaggtggagagtacaacgatcgg

SEQ ID NO: 271998 - DNA, 592 bp, Homo sapiens
  misc_feature: GYAE6OF02I0SRI.13.39.D06.1.454.CMB.1.raw
tcagtcacgtactacacgaccggtgctcgatttagtgacatctcgcagttctttgggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctctgcactggaaccagcagtgattgttggtggttatactatgtctcctgtaccaacaacaccaggacaacgaccccaaatcatgtattatgatgtactagtaacgccggtcctacgtacgggtcctgactccgtcttctctcgtcctactaagtctcggaccacgaccgccctcccgtacgacctactcctcgtcgggtcctaccgacggtcgtaggacggtagtgtacgttctagtattacttacgtcgtcttcgtaccttctagtacgtcggactacgggactacgtcctaaccgtacgttacggttaccttacggttccgggacgggaaccgggtaccgaacggtccgtaacggtacccgttacggtaccggtaccg

SEQ ID NO: 271999 - DNA, 549 bp, Homo sapiens
  misc_feature: GYAE6OF02HJN0D.13.39.D06.1.454.CMB.1.raw
  modified_base (358)..(358): a, c, t, g, unknown or other
  misc_feature (358)..(358): n is a, c, g, or t
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttaggtaccagcagaaaccaggacagcctccaagctgctcatttactggacatctatccgggaatcccgggtccctgaccgtattcagtggcngcgggtctgggacagtattcactctcaccatcagcagcctgcaggctaggaagtntgtggctagtttatacgtgtacgtanactaaatattataagtaactcctacgacggtaccttcgtaccgtttcggaccgggtaacggtaaccggaagggttaggaacgtaacgtaccgtaaacggtacgttacggg

SEQ ID NO: 272000 - DNA, 531 bp, Homo sapiens
  misc_feature: GYAE6OF02JOM9C.13.39.D06.1.454.CMB.1.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
  modified_base (412)..(412): a, c, t, g, unknown or other
  misc_feature (412)..(412): n is a, c, g, or t
  modified_base (437)..(437): a, c, t, g, unknown or other
  misc_feature (437)..(437): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgtttanacagctccaanaataagaacttcttagcttggacctagcagaaaccaggacagcctctaagctgctcatttacnggcatctatccgggaatccgggtcctgaccgattcgagtggacaggcggtcngggacagtactttcactcgtacacctatcagcagcctgcaggcctagaagnttggcgactagtttatacgtgtacngtactaattattactacgtacctcccttcgaacgtcctacgtacgtttcgggacggtacggactagggttgaacggtataaccgaacgacgtgg

SEQ ID NO: 272001 - DNA, 688 bp, Homo sapiens
  misc_feature: GYAE6OF02J1720.13.39.D06.1.454.CMB.1.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (546)..(546): a, c, t, g, unknown or other
  misc_feature (546)..(546): n is a, c, g, or t
tcagtcacgtactacacgaccggtgctcgatttagtgacatctcgcagttcgtttgggggggtctcaggaggcagcgctctcgggacgtctccaccatggcctgggctctgctattcctcaccctcctcactcaggcatagggtcctgggcccagtctgccctgactcagcctgcctccggtgtcctgggtctccgtggacagtcgatcaccatctcctagcagtaggaacngcagtnacttcgttaggacttatacgtacttgtcctcgtacggtaacccaaccacccacccgaaggccgaacccggcccctagacgtcactacgtattaggcggggtacaaggtaccgggcggtacgtacgtagggttacttccgactcggtccttcgtcgtacggtccttaaccgagttcggtacgaccaaccgtcccggtacccttaccgagtaacctaacgtccgttaccgtcggtccgtaccggacggtcgttaacgggacgtacggacgtcgtcgttaccgtttacgttacgtcggtctacgtcttacncgttagcgttacgttacggtttccttggttcggttcggttaccgtccgggttacggacggttaccgtaacgtcccgttaccgtacgtacgtacccgacgtaccgaccggtccctacccggtccccgttacgtacctttcccg

SEQ ID NO: 272002 - DNA, 831 bp, Homo sapiens
  misc_feature: GYAE6OF02HU7KN.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgaggacggccaccatacaactgacaagtccagccagagttgttttaatacagctccaaacaataagaacttcttaagcttaggtaccagtcaagaaaccaggacacgtacctacctaagtcctacgcctacctaattttacgtcgggactacgtaccgttacgtacccggggtaaactccccggggtaccctacggaacccgtagtttaccgaacggtcggaccgtagggtcccggggttaccgttagggggaaccctaaggtaccgttttacccgaccgtttcccgtaacctaaccccgtaacgttacccggaagtcccgtaaaccggtccctacgggtaccgtaacgggtaccgttaacgggaaaacggttaccgttagggtaccgggtacgtttaaacggttttttaaacgtttaccgttacggttaaccgtaacggtacgtttaaaaacgttttacgtttaaaagtttaacccggttaaccgtttaccccgttaccgggtaaccgggttacccgtttaacccggttaaccggtttttacccggggggaacccggggtaaaccggggttaaccgggtaaacggggttggtaaaccggtaacgtaaacccggtaaaccggttaacgttaacgggg

SEQ ID NO: 272003 - DNA, 555 bp, Homo sapiens
  misc_feature: GYAE6OF02IYX6W.13.39.D06.1.454.CMB.1.raw
  modified_base (297)..(297): a, c, t, g, unknown or other
  misc_feature (297)..(297): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataatatactctggtatcagcagaagtcaggccagtcccctgtcgctggtcatctatcaagntgccaagcgccctcgagggactcccgtagacgcgtacttcctcgtcggcctaccaacgtcgtacggtaactccgacgacccacgtcctacgaaccctatccgacggcccgggaccccagggtactagtaggacgtaggacggcttacgtacttaacgttacgtgtcgtacgggtcggttcgggacacggtacagaccacgtcggccctcgtatcgttcgttacggacgtcggaccacggtacctaccgtacctaacgg

SEQ ID NO: 272004 - DNA, 737 bp, Homo sapiens
  misc_feature: GYAE6OF02H8PO7.13.39.D06.1.454.CMB.1.raw
  modified_base (246)..(246): a, c, t, g, unknown or other
  misc_feature (246)..(246): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgaggacgggccaccatacaactgacagtccagccagagttgtttanacagcctaccaacaataaagaacttcttagcttcggtaccagcaagaaaccaggacagcctacctaagctcgcctctacttttacgcgggctactctacgtccggggaacgttccccgggtacccctacgaccgtattcgaggtcgcacgggcggtgtgggacagtactttcactccgtacacctatacacgtcgacgtaccgtgaccgtacggtaccgtaggtaaacggattacggggtcggtaaccgtttaaggtttttaacgttttaaccgttcgtttaaccgaaggttaactttaaacgtttaactttaaggtttaaaccgttaccgttacccccggttacccgggtacggttaccccgtttaccggtttaacccgggttttacccgggggaaaccgggggttaaccggggtaaccccgggtaaaggggttccggggttaaacgtaaacccggttaaacggtaaaacccgggtacggttaaccgggg

SEQ ID NO: 272005 - DNA, 527 bp, Homo sapiens
  misc_feature: GYAE6OF02HO1O5.13.39.D06.1.454.CMB.1.raw
  modified_base (234)..(234): a, c, t, g, unknown or other
  misc_feature (234)..(234): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
tcagtcacgtactacacgaccggtgctcgatttagtgacatctcgcagttctttgggggctacaacaggcaggcagggcagcaagatggtgttgcagacccaggtcttcatttctctgttgctctggatctctggtgcccaggggacatcgtgatgacccagtctccagactccctggctgtgtctctgggcgagagggccaccatcaactgcaagtccagccagagtgtttanacagctccaacaataagacttctagcttggtacagcagaaaccaggacagcctactaagctgctacatttactgggcatctagtccggaatccgggtcctgaccgattcagtcggcagcgggtctgggacagtatttcactactcacatcagcacgctgcaggctgaagatgngactagtttactactgtacagctaatnttatatactacctcgaggtcctacgtaccgtttcggaccggtacgggaaccgaggggttacggaacgtacgtaaccgtaaacgtacgtacggg

SEQ ID NO: 272006 - DNA, 518 bp, Homo sapiens
  misc_feature: GYAE6OF02IQPD8.13.39.D06.1.454.CMB.1.raw
  modified_base (237)..(237): a, c, t, g, unknown or other
  misc_feature (237)..(237): n is a, c, g, or t
  modified_base (440)..(440): a, c, t, g, unknown or other
  misc_feature (440)..(440): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaacaataagaacttctagcttggtacagcagaaccaggacacgcctctaagctgctcatttactggcatctagccggaatcccgggcctgaccgatttcgagtggctagcggtcgtgggactagtacttcgactctcaccgatcacgcagacctcgacaggactagaagatgtggactagtttattacgtgtanagactaatattaatagtactcgtacgagtctactacgttcggacgagggaccgtaaggtggagacgtacgaacgtacg

SEQ ID NO: 272007 - DNA, 736 bp, Homo sapiens
  misc_feature: GYAE6OF02JGVYF.13.39.D06.1.454.CMB.1.raw
  modified_base (178)..(178): a, c, t, g, unknown or other
  misc_feature (178)..(178): n is a, c, g, or t
  modified_base (242)..(242): a, c, t, g, unknown or other
  misc_feature (242)..(242): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaataatggcagataaatntacttcctggtatcagcagaagtcaggccagtcccctgtgctggtcagtctatcaagatgccaagtccggccctacgagggactcccgtagacgtcgacttctacgtcggccttaccaaaccgttcgtacgggtaacctccgtaacggtcccctaaacgttccgtacgaacccgtaacgtacccggtaacgggtaccccggggggtaaccccgtaacggggtcccgtttaaacgggttacggggtaacgttacggggtaacgggtacccggttaaggtaaacccgtttaacgttttaaccggttacgggtttaccggaacggggttcccggggtaacggggtaaccctagggacccgtaaggtcccgtaacgttcccgggaccccgggtacgtttacgttccggttacccggttttaaccgggtaacccgggttaccggggtaaacccgtaaacccgggttcccggtaacccggttaccccgggttaaacccgg

SEQ ID NO: 272008 - DNA, 531 bp, Homo sapiens
  misc_feature: GYAE6OF02HB5J1.13.39.D06.1.454.CMB.1.raw
  modified_base (236)..(236): a, c, t, g, unknown or other
  misc_feature (236)..(236): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcagaggccaccatcaactgcaagtccagccagagttgttttanacagctccaacaataagaacttcttaagcttaggaccagcagaaaccnggacagcctctagctgctcatttacnggcatctagtacggaatccgggtccngacgattcgagtgcagcggtctagggactagatttcgactcgtccacatcatcagcctgcagctagaacgntgngtactagttattactgtactagactaagttattacgacgttactaccgtcgtacgcttacgaccgtttacggcggtaacggaccgtaaggtcggtaagaacgtacgaacggtacttacggg

SEQ ID NO: 272009 - DNA, 751 bp, Homo sapiens
  misc_feature: GYAE6OF02HMRN7.13.39.D06.1.454.CMB.1.raw
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttaatacagcctaccaaacaaataacgaacttacttagcttggtaccagacaacgaaaccaggacacgcctacctaagctgctactatttacgcggctattccgtaagtccggggtaacgtccccgggggtaccctggaacccgtactttcgaggttcggacgacgggtccgggttacggtacggggactaacggttattttaccaccgtttaccgtaccaacccgtattacccgaaggtaccgtaaccggtccgttaagccggtaacgggtaccgttaagggaaacgtacgtttagggtccgggtacgttaaggtttttaaccgtttacgttacgttaccgtaagtaaccgttaaaagtttaacgttttaaagttaaccggtttcccttaccccgttaccgggtaccggttaccctacccggtttaacccggtttaccggggtacccggggtaacgggtaacccgttaaggggtacggtaacggtaaccggttaaccgtaaaacggttaacccgg

SEQ ID NO: 272010 - DNA, 558 bp, Homo sapiens
  misc_feature: GYAE6OF02GSEA8.13.39.D06.1.454.CMB.1.raw
  modified_base (238)..(238): a, c, t, g, unknown or other
  misc_feature (238)..(238): n is a, c, g, or t
  modified_base (305)..(305): a, c, t, g, unknown or other
  misc_feature (305)..(305): n is a, c, g, or t
  modified_base (388)..(388): a, c, t, g, unknown or other
  misc_feature (388)..(388): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgttttanacagcctccaacaataagaacttcttagcttggtaccagcagaaaccaggacagcctcctaagctgntcatttactgggcatctatccgggaatcccgggtcctgaccgattcagtggcagcgggtctgggacagatttcactctcaccntcagcacgcctgcgaggctaggacgntgtcggntagtttattacgtgtacgagacctaatgtttaaatagttaccttccgtaccggtacgtcgttacctaccggttttaccgggacgggttaacgggacctaaggggtcggaacgaacgtaccgaaaccgtagttacggg

SEQ ID NO: 272011 - DNA, 588 bp, Homo sapiens
  misc_feature: GYAE6OF02GNTGH.13.39.D06.1.454.CMB.1.raw
  modified_base (498)..(498): a, c, t, g, unknown or other
  misc_feature (498)..(498): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctggaaataaattggacagataaatatacttcctaggtatcagcagaagtcacggccacgtcccctgtcgcgtggtcatctatcaagatgaccgaagccggccctacgacgggactcccgtgacggtcgtattcgtacgtcggcctaccgtaactcgtacgggaactcgacgccctactcctacgaaccctatccgacggacccgggacccagggtactagtggatcgaggactacgtacttacgttactggtacgagggtcggtacggacgagacgngaccgacgtccggcccgtacgttacgtcgttccgttacgggaaccggttcgggaacccgtaagggtcccgtaaccggtaccgtaaccggg

SEQ ID NO: 272012 - DNA, 754 bp, Homo sapiens
  misc_feature: GYAE6OF02IEZ1S.13.39.D06.1.454.CMB.1.raw
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacgggacatcgtgatgacccagtctccagacctcccgtggctgtgtctcgtgggcgagacgggccaccatcaactgacaagtccagccagtagttgttttanacagctaccaaacgaataaacgtaacttnttaagcttaggtaaccagacaagaaaacccgaggaccacgaccttaccgtaaagccttgacctactaacgtttttacgcgggacttaacgttaccgttaacggttaccccggggtaaagttcccccggggttaccttacggaacccgtaagttttccgaagggttcggaccgtagggccgggttacgtggggtaaccaaggttctttaccgaactcctaacgaccctagttaccgagtcctacgtacccgttagacggtaaacggtccgtaaggaaagtacgtcgggttaacgtacgtttaaacggttttaactttaccgacgttacgaacggtactttaaaggttactttaaagtaaccgtttaccgtaccgtaccggtaacggttccttaacggttaaccggtttccggggaacggtaaacccgggtaacgtaaggggttacggaaacgtaaccggtaaccgtaacggaaccgtttggg

SEQ ID NO: 272013 - DNA, 546 bp, Homo sapiens
  misc_feature: GYAE6OF02HODL3.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctccaacaataagaacttcttagcttggtaccagcagaaaccaggacagcctcctaagctgctcatttactgggcatctatccgggactccgggtcctcgaccgattcgagtggcaggcgggtctgggacagtactttcactctcaccatcagcacgtcctgcgaggtctggaagtagtggtggcttagtttacttacgtgtacagtactaattattatacgttacctccgtacgtagtcctctaccgttcgggaccggtacgggaccgtaggtacgggagtacgtaacgaacgtagttacggg

SEQ ID NO: 272014 - DNA, 543 bp, Homo sapiens
  misc_feature: GYAE6OF02GPUM7.13.39.D06.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (375)..(375): a, c, t, g, unknown or other
  misc_feature (375)..(375): n is a, c, g, or t
  modified_base (414)..(414): a, c, t, g, unknown or other
  misc_feature (414)..(414): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctccaacaataagaacttcttagcttggtaccagcagaaaccaggacagcctcctaagctgctcatttacnggcatctagtccgggaatccgggtcctgactgattcaggtggctagcgggtctgggacagtntttcactctcactatcagcagccctgcgaggctagaagntgtggacttagtttattacgtgtacgagtactaattattaatacgttactccgtaccggtacggtcttacctaccggtttcgggaccggtaacggaccgtagggtacggagacgtacgaacgtaaccgg

SEQ ID NO: 272015 - DNA, 503 bp, Homo sapiens
  misc_feature: GYAE6OF02FHH6C.13.39.D06.1.454.CMB.1.raw
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggactagtttattactgtcagcaatattatagtactcctcgagctcactttcggcggaggaccaagggtcggagactacgaaacgtaacg

SEQ ID NO: 272016 - DNA, 556 bp, Homo sapiens
  misc_feature: GYAE6OF02GV664.13.39.D06.1.454.CMB.1.raw
  modified_base (237)..(237): a, c, t, g, unknown or other
  misc_feature (237)..(237): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
tcagtcacgtactacacgaccggtgctcgatttagtgacatctcgcagttctttggggctacaacaggcaggcaggggcagcaagagtggtgttgcagacccaggtcttcatttctctgttgctctggatctctggtgcccacggggacatcgtgatgacccagtctccagactccctggctgtgtctctgggcgagagggccaccatcaactgccaagtccagccagagtgtttanacagctccaacatagaacttctagcttggtaccagcagaaccaggacagcctctaagctgctcatttacnggcatctatccgggaatccgggtcctgaccgattcagtggcagcgggtcngggtacngattcgactcgtcaccatcagcacgcctgctggacctgaagtactgtcgctagtttacttacgtgtcacgtctaaactatttaatacgtaccttcccgtccgaggtaccttacaccgttttacggggccgggtaagggtaccccgtaaggggttacggaaacggtacgtaaccgtaaaccggacttaacggg

SEQ ID NO: 272017 - DNA, 796 bp, Homo sapiens
  misc_feature: GYAE6OF02HUV09.13.39.D06.1.454.CMB.1.raw
  modified_base (168)..(168): a, c, t, g, unknown or other
  misc_feature (168)..(168): n is a, c, g, or t
  modified_base (231)..(231): a, c, t, g, unknown or other
  misc_feature (231)..(231): n is a, c, g, or t
  modified_base (347)..(347): a, c, t, g, unknown or other
  misc_feature (347)..(347): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtcnccagacctcctggctgtgtctcgtgggcgagagggccaccatcaactgacaagtccagccagngttgttttacacgagctaccaacaaataagaactttcttaagctttaggtaccaggacaacgaaaccgaggaactacgacccgtacctaaagctgaccttacgtaacttttaacgngggtacaacttccgtaacggttaccggggaaacgttccccgggggttaccctacggtaacccgtacgtttaccggacggtcgggcgtaacgggcggggtttaccgtacgggggaacctagggttacgttttaccgaccttaccgttaacccgacccgtaacgtaccgacggtaccgaacgtccccgtgaccgaacgggtccgtacggtaaacgtagtttacgggtacgggtacgtttaacgtttttaacgttaacggtttccggtaacgttaacgtacgttaaactttaaacgttaacgtttaacgttacccttacccggttaccggttaaccggtacccgttaccgtttaaccggggtttcccgggtaaccggggtaaaccggggtaaccggtaacggggttaccgttaacggtaaacgtttaacccggaaacggtttaaacccgggg

SEQ ID NO: 272018 - DNA, 533 bp, Homo sapiens
  misc_feature: GYAE6OF02HKLKQ.13.39.D06.1.454.CMB.1.raw
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (430)..(430): a, c, t, g, unknown or other
  misc_feature (430)..(430): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttctagcttggtaccagcagaaaccaggacagcctctaagctgctcatttacnggcatctatccgggaatcccgggtcctgaccgattcagtcggcagcgggtctgggacagtatttcacgtctcacatcagcagcctgcaggctagagatgtgctagtttatacgtgtagagntaattattatagtaccttccacgtacgtcctctaccggtttcgggaccggtacggggaacctaagggtacgggacgtaacgtaaccgaaacggtacttacggg

SEQ ID NO: 272019 - DNA, 691 bp, Homo sapiens
  misc_feature: GYAE6OF02HI730.13.39.D06.1.454.CMB.1.raw
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagacggccacatcaactgacaagtccagccagtagttgttttanacagcctaccaaacaataagaacttacttagcttagtaccagacaagaaaccaggacacgcctacctaagctgctactatttacgnggactatctacgtccgggaacgtcccgggtacctcggaaccgtactttacgacgttcggacgtacggtccggggttacgtacggggactacggttacgtttacgaccgttaccgtaccaaccctagtaccaacgccacggtcccgtacggacgtacggtactaggaaagtacgtgggttacggacgttagttttaacgttacgttacgttacctacggtaacttaacgttaatttaacgttaacgttacccgttaccgtaccggtacggttaccgttaccgtaccggttttacgggacggggttaaccgggtaaccggtaacgggttacgggaacggtaacgtaacggtaaaccggtagttacggg

SEQ ID NO: 272020 - DNA, 534 bp, Homo sapiens
  misc_feature: GYAE6OF02GV1ZM.13.39.D06.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctccaacaataagaacttcttagcttggtaccagcagaaaccaggacagcctcctaagctgctcatttacngggcatctatccgggaatcccgggtccctgaccgtattcagtggcagcgggtctgggacagtatttcactctcaccatcagcacgcctgcaggctagaagatgtgactagtttatactgtcagactaattattatagttacctccgtaccgtagtcctcgtacgtttccgggacggtacggaccgtaagggtcggaacgtaatacgtaaacgacgttacgg

SEQ ID NO: 272021 - DNA, 677 bp, Homo sapiens
  misc_feature: GYAE6OF02JA4IK.13.39.D06.1.454.CMB.1.raw
  modified_base (178)..(178): a, c, t, g, unknown or other
  misc_feature (178)..(178): n is a, c, g, or t
  modified_base (250)..(250): a, c, t, g, unknown or other
  misc_feature (250)..(250): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctnagtcgtcccgtgtccccaggacaggacacgccagccatccacctgctcgtaggaaataatggacagataatntactctagtatcagcagagtcaggccagtcccctgtcgcgtggtctactcgtactaccgaagtatcgaccgaacggtccgtccctacggtaacggggactcccgtagacggtacgtacgttacgtccgtcgggtaccctaccgtaccgttaccggtacggttaacctccgtaacgcctaaccgttaccgtacgtaccctacgtaccgtaaccgggacccggttacccgaacggtacgttaaccggtacggtaacggttcggaaacgggttccgtaagttaccgttaacgtttaccgtacgggtaccgtaacgggtcggttaaccgggtaacgccgttaacggaccgtcgttaacgcccgtacgtaaccgtcgtcggttaccgtaggaccgtacggaaccgtacgggtacccttaccggacttaacgg

SEQ ID NO: 272022 - DNA, 601 bp, Homo sapiens
  misc_feature: GYAE6OF02GETAQ.13.39.D06.1.454.CMB.1.raw
  modified_base (428)..(428): a, c, t, g, unknown or other
  misc_feature (428)..(428): n is a, c, g, or t
tcagtcacgtactacacgaccggtgctcgatttagtgacatctcgcgagttctttgggggcctacaacaggcgaggccagggggcagcaaggatggtgttgcagacccaggtcttcatttctctgttgctcttggatctctggtggtcccacgggggtacatcgttaggatcgacccagtctccgagactccctggctgtgtctcgtgggcgagagggccaccatccaacgtgcaagtccagccagagtgttttaacacagcgtccaaacaataagaacttctagtcttggtaccagcaggaaacccaggacacgcctacgtaaggctgctctatttacgtggtctatctagtccgggaatcccgggtacctgaccgtatcgagtcggcgaggcggtctgggacagtactcactctacaccatcgacncagactcgaacctagaacgtacttgccttaatttatttctgttaccaccgtagtacgtcggtacgttacctaaccgttactacgtttcggaccgacgggtaccgaacggtcgtacgggtaactacttaacgaaggtacgtaacggttcggtacggtcgtacgaccgtaacccg

SEQ ID NO: 272023 - DNA, 606 bp, Homo sapiens
  misc_feature: GYAE6OF02GMJ4O.13.39.D06.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctaccaanaataagaacttcttaagcttggtaccagtacaagaaaccaggacagccctacctaagctgctactatttacgnggacatctaagtccgggaaacgtcccggggtcctaggaaccgtattaccgaggtggaccgaggtccgggtcgtgggaccagtactttctactactcaccactacacgactacgctcgcgaggctagagagtgtacggtacgtagtttactacgttcgtactagtactaattaattactaacgtaccttaccgtccgtacggtccgttaccgtaccgtttacgggaccgggtacgggtaaccgtaacgggtaggtaaccgagtaaccgaaccggtagttacggg

SEQ ID NO: 272024 - DNA, 940 bp, Homo sapiens
  misc_feature: GYAE6OF02I0SPJ.13.39.D06.1.454.CMB.1.raw
  modified_base (243)..(243): a, c, t, g, unknown or other
  misc_feature (243)..(243): n is a, c, g, or t
tcagtcacgtactacacgaccggtgctcgatttagtgacatctcgcagttctttgggggctacaacaggcaggcaggggcagcaagatggtgttgcagacccaggtcttcatttctcttttgctctggatctctggtgcccacggggacatcgtgatcgacccagtctccagactccctggctgtgtctcgtgggcgagagggccaccatcaactgacaacgtccagccagagttagttttanacacgtctacccaaactaaataaagtaacctttcgtttaagtcgtttacggttaacccaaggtaccaacggaaaaacccaggaaccaacgacccccttacccgtaaacggtccgttaggtaccttaccgtaactttttaaccggtacgggggacctaacgtttacccgttaacggttaaccccgggggtaaaccggtttcccccgggggggttccccttacggggtaaaccccgtaacggttttaccgacgggtttaccggggtaccgtaacggggtcccggggggtttacttacgggggggaaccttaagggttaaccttttaccgtacccttacccgttacccgtaacccgtaacgttaccgaacggtacccgaaccggtacccgttacgggacccgtaacgggtacccgttaagggaaacggttagttacgggttacgggttaaccgtttaacggtttttaacgtttaaccgttacggttaaccgaagttaaccgttaaatttaacgttttaacgttaaacggttacccgttaccccggttaccggtaccgggttccgtttacccggttaaccgggttttacccgggggaaccgggggtaaaccggggtaacccggttaaacggggggttacgggtaaacggtaaccgggttaaacccgaaaacccgggttaaccgggttacgggttaaccggg

SEQ ID NO: 272025 - DNA, 546 bp, Homo sapiens
  misc_feature: GYAE6OF02IE0X9.13.39.D06.1.454.CMB.1.raw
  modified_base (238)..(238): a, c, t, g, unknown or other
  misc_feature (238)..(238): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctccaacaataagaacttcttagcttggtaccagcagaaaccaggacagcctacctaagctgctcatttactggcatctagtccgggaatcccgggtccctgacccgattcagtggcaggcggtctgggacagtatttcactctcaccatcagcagccctgctagtctagagtatggtgactagtttaattacgtgtacagtactaattattagtacgttactccgtaccgacgtccgtcgtacgtttccgggacgggtacggaacccgtagggtacggaagtacgtaacgaacggtatacggg

SEQ ID NO: 272026 - DNA, 833 bp, Homo sapiens
  misc_feature: GYAE6OF02H23QN.13.39.D06.1.454.CMB.1.raw
  modified_base (330)..(330): a, c, t, g, unknown or other
  misc_feature (330)..(330): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccacatcaactgcaagtccagccagagttgttttaatacagtctaccaaacaaataagaacttctagtcttggtaaccagtcaacgaaaccaggacacgtcctacctaagctcgctactatttacgnggtactatcgtaacgtccgggtaactcccggggtcctaggaccgtattcgaggtcgacgtaaggtccgggttacgtacggggaactacggttacttttaccgacgttaccgtaccgtaacccgtacgtaccgtaacggacccgtaacggtcccgttacggtacccggtaacggtaccgttaacgggtaaacgttacggttacgggttacgggtaaccgtttaaacggtttttaaccgtttaaccgtttacgggtttaccgtaaacggttaaccgtttaaaaacggtttaaacgttttaaacgtttaaacccgggtttaaccccgtttaccccggtttaacccgggtaaccgggttacccgttttaacccgggtttaacccgggttttaacccggggggtaacccggggtaaacccggggttaacccggggtttaaacgggggtaccgggttaaaccgggttaaacccggtttaaacccggtaaaacccgggtttaaacccggg

SEQ ID NO: 272027 - DNA, 630 bp, Homo sapiens
  misc_feature: GYAE6OF02IZ8ZZ.13.39.D06.1.454.CMB.1.raw
  modified_base (237)..(237): a, c, t, g, unknown or other
  misc_feature (237)..(237): n is a, c, g, or t
  modified_base (367)..(367): a, c, t, g, unknown or other
  misc_feature (367)..(367): n is a, c, g, or t
  modified_base (509)..(509): a, c, t, g, unknown or other
  misc_feature (509)..(509): n is a, c, g, or t
  modified_base (601)..(601): a, c, t, g, unknown or other
  misc_feature (601)..(601): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaatgcaagtccagccagagttgttttanacagctaccaacaaataacgtaacttacttagcgttggtaccaggcaagaaaccaggacacgcctacctaagcctgctactatttacgtaggctatcgtataccgggaacgtcccgggtacctgaccgtnttcgaggtgcgagtcgggtcgtaggggactagtacgtttcaacgtctaccgaacctatccgagtaccacggtcctaggaccgagggtctaggaaagacgttggcgtacgttaagttttactacgtgtacgagtataaagttnttaaacgtacgttactccgtacccggaagtcccgttaaccgttacggttaccggggaacgggttaacgggaaccctaaggggtccggtaaanaaccggtaacggtaaaccgtaggtacggg

SEQ ID NO: 272028 - DNA, 591 bp, Homo sapiens
  misc_feature: GYAE6OF02IOA8O.13.39.D06.1.454.CMB.1.raw
  modified_base (236)..(236): a, c, t, g, unknown or other
  misc_feature (236)..(236): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaacaaataagaacttcttagcttggtaccagcagaaaccaggacagcctacctaagctgctctatttactggcatctagtccggaagtcccgggtccctggacctagttcgagtcggcaggcgggtcgtacgggactaaggtctttcactctcacctactcagcacgcctgcgagctagaacgagtgtggacttagtttacttacgttgtacacgtactaaattagttaagtacgttaccgttaccgtaccgtacggtccttacgtaccggttttacgggaccgggtaacgggtaaccggtaagggttacggaacggtacgttaaccgaaccggtaacgttacggg

SEQ ID NO: 272029 - DNA, 713 bp, Homo sapiens
  misc_feature: GYAE6OF02H7A38.13.39.D06.1.454.CMB.1.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (515)..(515): a, c, t, g, unknown or other
  misc_feature (515)..(515): n is a, c, g, or t
tcagtcacgtactacacgaccggtgctcgatttagtgacatctcgcagttctttgggggctacaacaggcaggcaggggcagcaagatggtgttgcagacccaggtcttcattttctctgttgctctggatctctggtgcccgaggggacatcgtgatcgacccagtctccagacctccctggctgtgtctcgtgggcgagacgggccacatcaactgacaagtccagccagtagttgtttanacagctaccaaanaataacgtaacttcgttaagtcgttagtaccagcaaagaaaccaggaaccacgacccttacgtaagcctagtcttactagttttacgcgggactaactacgtacggtaccgggtaacgtccccggggtacctacggaccgtaattccgaaggtcggacgtaccggggtcgggttacgtcgggaactagggttacttttaccacctctaccaacccgtataccacgacacgtccgtacgacggtacggtgtaacgtaagngttaggtacggtactttaaggtttaccgttaactcggtaacgaacggttaactaaaagtttcgtttaagttaaccgttaccgttaccccgttacggtacgtccgttaacgttaaccgggtttacggggaacggtaacgggtaacccggtaagggtaccggtaagtaacccgttaaaacggtaacccgggtagttcggg

SEQ ID NO: 272030 - DNA, 699 bp, Homo sapiens
  misc_feature: GYAE6OF02GK84Y.13.39.D06.1.454.CMB.1.raw
  modified_base (238)..(238): a, c, t, g, unknown or other
  misc_feature (238)..(238): n is a, c, g, or t
  modified_base (340)..(340): a, c, t, g, unknown or other
  misc_feature (340)..(340): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctaccaaacaaataagtaacttcttaagtcttggtacccagacgaacgaaaaccgaggaacagccctaccgtaagcctgccttactaagttttaccgngggtacctatcctacggtaccgggtaaacgtcccggggtaccctggaacccgtattacgaggttcggactacgggcgggttcgtaggggactacgtactttcgaacctcgttaccacctactcacgaccgacgtccgtcgaccgtaaggtcctaggaacgtaacgttcgggtacggtcgttaagttttaacgttacttaaggttccgaaaggttaaccttaaatttaacgttaaagttaaccgttaacctacccgtacggtaccgtacttaccgtaaccggttttcgggaacccgggttaagggaacccgttaaagggtcggtaacggtaacgtaaccggtaaacgtaccggttacggg

SEQ ID NO: 272031 - DNA, 567 bp, Homo sapiens
  misc_feature: GYAE6OF02IZXCF.13.39.D06.1.454.CMB.1.raw
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccacatcaactgacaagtccagccagagttgtttanacagctaccaacaataacgaacttcttagcgttaggtaaccagacaacgaaaccaggaacagaccctctaagctgctctatttacgnggcatctagtaccgggaacgtccgggtccngacctattcgaggtcgcgacggcgggtctagggactagtatttccacttctacaccngtacacgcgagcctgacagctagaacgtntcgtacgtatagtttattactgtacatactaattagtaattacgtacctaccgtacgacgtctccgttacgttcgggacggtacgggaaccgtaagggtacggaagtacgaacctaacggtctacgg

SEQ ID NO: 272032 - DNA, 738 bp, Homo sapiens
  misc_feature: GYAE6OF02I5ULI.13.39.D06.1.454.CMB.1.raw
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatcgacccagtctccagacctccctggctggtgtctcgtgggcgaggagggcccaccatcaactggacaagtccagccagtagttgtttanacngtacctaccaaanaataagacttctagcttggtaaccagcaagaaccagacacgcctacctaagctagctactactttacgnggctatcgtaacggtaccggtaacgtcccggggttacccagttaccgtacgtttacgacgggttcggacctacggggtccgggttacggtaccgggggtaaactaagggttcttttaccgaacccgtttcgtaaccccgtaaacctacgttaacccgtagaacccgaccgggtaccgttcggcggaaacggtccgttaaaggaccgtagttcggtacgggtacttacgttttaaccgttagtacgttaaccgtacgtaacttaaacgttagtttaaacgttacgttaacccggtttccccgacggtacgggttacccttaccggtagtttcccggggggaaccggtaccgggtaaccgggttagggtaccgggtaacgttaacggtaacccgtaaaggtaacccgg

SEQ ID NO: 272033 - DNA, 774 bp, Homo sapiens
  misc_feature: GYAE6OF02IUN23.13.39.D06.1.454.CMB.1.raw
  modified_base (255)..(255): a, c, t, g, unknown or other
  misc_feature (255)..(255): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacattcgtgatgacccagtctccagactccgtggctgtgtctcgtgggcgagacggccacatcaactgacaacgtcagccagtagttgtttacacagcctaaccaanaataaacgactttcttaagtcgttacggtaaccagacgaagaaaccgaggtaccacgtcccttactaagtctggcttaccgtaattttaccgcgggactacgttaccgttacgtacccggggaacgttcccgggtacccgtagtacccgtacttcgtaggttcggacgtacgggtcgggtacgtacggggactacggttactttccgaacgttcccttacgaacccctagtaccgacgtccgtacgggctaccgggacgtaccggtacgtttaccgggagtagttcgggtcggttaaccgttaagttttaacgtttaccgtacgtaccgaaaggttaacctaaagtttttaacttacgttaaaccggttacccgttaccgtttacccgggaagtttaccccggtacggttttaacccggttaccggggtaaacccgggttaaccgggttaaaccgtaaacgggggttacggtaacccggaaacgtttaaaacccggtaaacgggttaacccggttcggg

SEQ ID NO: 272034 - DNA, 592 bp, Homo sapiens
  misc_feature: GYAE6OF02F2PRY.13.39.D06.1.454.CMB.1.raw
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataattggacagataaatatacttcctggtatcagcagaagtcaggccagtcccctgtgctggtcatctatcaagatgaccaacgccggccctacgacgggactccctgacgcgtacttctacgtcggtcctacccaacttccgtacgggtaaccttcgacgcccaccttcgtacgaaccactaccgaccggtccgggaaccccgacggtactagttcggacgtagggacggtacgtacgtaacttagttacgttggtaccgaggtaccggtagggaccgagacgacgcctacgtccggcccgtatacgtcgttccgttacggaacgtcgggaaccggtaccggtaccgtaccgtcccgtaacgg

SEQ ID NO: 272035 - DNA, 504 bp, Homo sapiens
  misc_feature: GYAE6OF02FULMC.13.39.D06.1.454.CMB.1.raw
  modified_base (237)..(237): a, c, t, g, unknown or other
  misc_feature (237)..(237): n is a, c, g, or t
  modified_base (410)..(410): a, c, t, g, unknown or other
  misc_feature (410)..(410): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagagngtggctagtttattacgtgtcagcaatatatagtactcctcgacgtctcactttcggcggtacggactaagggtggagactacgaacgattcgg

SEQ ID NO: 272036 - DNA, 771 bp, Homo sapiens
  misc_feature: GYAE6OF02IOW8A.13.39.D06.1.454.CMB.1.raw
tcagtcacgtactacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccaccctcagccgtcgtcgggacccccgggcaggacgggtcaccatctcttgttctggaacgcagctaccaacgaccggaactggtagataataaactggtaccagcagctcccgaggaaccggccccaaactcctacatctaatactaataactccgaccggccctacgacgggactcccgtagacccgtattcctctcgcctacctaacgtcctacggacctaccctcaccgtccctcccgtcggaccctacgtaccgtacgggttcccggacccttaccgtaacggttccgtacgggtaacgggtacgttacgggtacgggttaccgttaacggttaaactttttacgttaaccgttacgggtacgtaacctacggtaacccttaaagttaacccgttaattacccggtaaccctaaccccgttaaggtaacggtttcgggttttaccggtttcgggggtttacgggtttacccgggggaaccggggtaacggggtaaaccccgtaacgggttacccggttacccggtaacccgggtttacccggttaaggggtaaccccgtacccgggtaccccggttaaacccgggg

SEQ ID NO: 272037 - DNA, 672 bp, Homo sapiens
  misc_feature: GYAE6OF02JEM5B.13.39.D06.1.454.CMB.1.raw
  modified_base (243)..(243): a, c, t, g, unknown or other
  misc_feature (243)..(243): n is a, c, g, or t
  modified_base (331)..(331): a, c, t, g, unknown or other
  misc_feature (331)..(331): n is a, c, g, or t
tcagtcacgtactacacgaccggtgctcgatttagtgacatctcgcagttctttgggggctacaacaggcagggcaggggcagcaagatggtgttgcagacccaggtcttcatttctctgttgctctggatctctggtgcccacggggacatcgtgatgacccagtctccagactccctggctgtgtctctgggacgaggacggccaccatcaactgcaagtcccagccagaggttgttttanacagcctaccgaaactaataacgaacttcttaagctttggtaccagcaagtaaccaggacacgcctctaagctgacttctatttacgnggcagtctacgtccgggtaactccggggtaccctagaccgtattccgagtcggacaggtccgggttcaggggactggtactttcgtaacgtcctaacactacgtccaacggcgtacgaccgttcgacggtaggtacgtacgaaacgggtatcggtacggtacgttaacgttttaacgttacgttaggtaccaacgttaacttaacgttaacttttaacgtaaacgttcccttaaccctacgggtaagcccgttaacccgtacggtttccgggggaaaccggtaaccgggtacgttaacgggagggttaaccgtaacgtaacccggtaaaaccgtcgtcggg

SEQ ID NO: 272038 - DNA, 723 bp, Homo sapiens
  misc_feature: GYAE6OF02INN4F.13.39.D06.1.454.CMB.1.raw
  modified_base (267)..(267): a, c, t, g, unknown or other
  misc_feature (267)..(267): n is a, c, g, or t
  modified_base (345)..(345): a, c, t, g, unknown or other
  misc_feature (345)..(345): n is a, c, g, or t
tcagtcacgtactacacgaccggtgctcgattagtgacatctcgcagttctttgggggctacaacaggcaggcagggcagcaagatggtgttgcagacccaggtcttcatttctctgttgctctggatctctggtgcccgacggggacatcgtgatcggacccagtctccagactccctggctgtgtctcgtgggcgaggacgggcccaccataccaacgtgcaacgtccacgccaggtagttgtttttaacacgacgcctaccaanaaataacgtaacttcgttagtccgttacggtaccagcaacgaaaccaggacacgcctctaagctcgctctatttacgnggactatcgtacgtccgggtaacgtcccggtcctacgacgtctcaggtcgacgtacgggtcggtcgtacgggactaaggttccttacacccttactacccgacctacgtccgaacgtaccgacctaccggtacgccgaacggtcgttaagaaacggttagttcgggtaggtaccggttttaacggttttaaccgttacggttacgtacgtaagggtaacccgtttaaattaaagttttaaccggtaaccgttaacccgttaccccggttacgtaacggttacccgtacttttacccgggttaccggggtacgggtaaaccggggtaaccggttaagggtaccgggtaaggtaacccttaacgggaacgtaacggtcgg

SEQ ID NO: 272039 - DNA, 528 bp, Homo sapiens
  misc_feature: GYAE6OF02HXKV6.13.39.D06.1.454.CMB.1.raw
  modified_base (321)..(321): a, c, t, g, unknown or other
  misc_feature (321)..(321): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
tcagtcacgtactacacgaccggtgctcgatttagtgacatctcgcagttctttggggggctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgcaagtccagccagagttgttttatacagtctccaaacataaagaacttcttagcttggtaccagcaagaaaccaggaacagcctacgtaagctgctcatttacgngggcatctagtccggaatccgggtcctgaccctnttcgagtggcaggcggtcngggactggacttcgactctcacctatcagcacgcctgacgagctagaagngtgtgtctagtttattactgtactanatagtattactatactcctacgtgctcgtaccgtttcggcggaggacgtaaggtggaagtaacgtcaacggtatacgg

SEQ ID NO: 272040 - DNA, 798 bp, Homo sapiens
  misc_feature: GYAE6OF02JI7J6.13.39.D06.1.454.CMB.1.raw
  modified_base (242)..(242): a, c, t, g, unknown or other
  misc_feature (242)..(242): n is a, c, g, or t
  modified_base (381)..(381): a, c, t, g, unknown or other
  misc_feature (381)..(381): n is a, c, g, or t
  modified_base (789)..(789): a, c, t, g, unknown or other
  misc_feature (789)..(789): n is a, c, g, or t
tcagtcacgtactacacgaccggtgctcgatttagtgacatctcgcagttctttgggggtctacaacaggcaggcaggggcgagcaagatggtgttgcagacccaggtcttcatttctctgttgctctggatctctggtgcccacgggacatcgtgatgacccagtctcagacctcctgctgtgtctctgggcgagacggccaccatcaactgaccaagtccaagccagtagttgttttaanacacgctaccaaacaaattaaacgaactttaccttaagtaccgtttcggtaaccctaaggaccaacgaaaaacccgacggaacgtaacggccccttaccgtaaacggccttacgtaccgttacctaacggtttttaacncggggttaccaactttacgttaccgttacccgggggtaaacgttccccgggggtttccccaccggtaaccgtacctttaccggaggttcgggccgtaagggcccggggttacgttacggggtaccgtaagttacgttttacccgtaaccgttcgtacccaaccgttacacccgaacgtcaaccgtccgttaccgacgacggtccttaaggaaacggttactggttacggaccgtttaggttttaaacctttacgacggtttcaaaccggtattaaaccgtttagttaaacgttaaccgttaacccgttctacccggtaacggttaccttacccgtttaagggtttccccgggaagggtaacccgggtagttaaacgggtacgttaaggaaacttaccggtaaaaccgngtttacggg

SEQ ID NO: 272041 - DNA, 532 bp, Homo sapiens
  misc_feature: GYAE6OF02F0SPO.13.39.D06.1.454.CMB.1.raw
  modified_base (178)..(178): a, c, t, g, unknown or other
  misc_feature (178)..(178): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (481)..(481): a, c, t, g, unknown or other
  misc_feature (481)..(481): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatatacttcctgtatcagcagaagtcaggccagtcccctgtgctgtcatctatcaagatgaccaagccgcctacgacggactcccgtgacgcgtatttctcgtggcctaccaattccgtagggaacctcacgccactctcgaccatccgacggcccgggtaaccgaggtacctagtgggaactggacggtctaggacttattacgtgtacgnggtcggngacgagcacgcacgtcgccctntacgtcgtacgtacggacgtacgggaccgaaggtcccgaccgtacgtaacg

SEQ ID NO: 272042 - DNA, 608 bp, Homo sapiens
  misc_feature: GYAE6OF02HTKJT.13.39.D06.1.454.CMB.1.raw
  modified_base (246)..(246): a, c, t, g, unknown or other
  misc_feature (246)..(246): n is a, c, g, or t
  modified_base (335)..(335): a, c, t, g, unknown or other
  misc_feature (335)..(335): n is a, c, g, or t
  modified_base (450)..(450): a, c, t, g, unknown or other
  misc_feature (450)..(450): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatcgacccagtctccagactccctggctgtgtctcgtgggcgagacgggccaccatacaactgacaacgtccagccagtagttgttttanacagctaccaaacaataacgaacttcttagcttaggtaccagacaagaaaccgagacacgacctactaagcgtcactactactttacgnggacactcgtacgtaccggtacgtcccgggtacctggaccgtatcgaggtcgacgacggtccgggtcgacgggactagtacgtttaccactcctacaccgtatccgagaccgacnccgtgacaggctagaagtcgttggtagaccttagttacgtactcgtacacgtactaattacttagaaccttaccgccgtaccgtagtcctaccggttacggttacgggacgggtaacgaccgtagggtacgagttaaccgtacgaacgtacgtaacgg

SEQ ID NO: 272043 - DNA, 634 bp, Homo sapiens
  misc_feature: GYAE6OF02HOUOV.13.39.D06.1.454.CMB.1.raw
  modified_base (247)..(247): a, c, t, g, unknown or other
  misc_feature (247)..(247): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
  modified_base (519)..(519): a, c, t, g, unknown or other
  misc_feature (519)..(519): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctcgtggtgcccgacggggacatcgtgatcgacccagtctccagacctccctggctgtgtctcgtgggcgagcggccaccatcaactgacaagtcccagccagtacgttgttttaanacgacgtcctaccaaaactaaagtaactaacctttacgtacgtcgtttaacggacctaggacaaacggaaaccgagggaacacgtcctacgtaagctgactcgtacgtttcgtggactactcgtagtccggaacgttcccgggtcctagaccgtnttcgaggtnccgtagtcggtancgggactagtactttcactcgtaccaactncgacgncgtctaggcgacggtacnggaagtntggtacgtacgttagttttacacgttcgtaccanacgtaatttacgttaactacgttacctccggtacgaccggtattcccgttaccggttagggacccggtaaggaccgtacgggttagaacgttacggaacggtaaccgacgtcggg

SEQ ID NO: 272044 - DNA, 670 bp, Homo sapiens
  misc_feature: GYAE6OF02HM3KL.13.39.D06.1.454.CMB.1.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggaccagtcgatcaccatctcctgcactggaaacngcagtgatcgttggacttatagacttgtctcctggtaccaacaccacccaggcaacggccccagacgtcatcatttagnggggacaagtacgggcggtccgtcgacgggtactttaccgacgttccgtcttcctccgtcggtccttaccgaacggttccgttacggaccgaaaccgtaccgggtccctcccgtacgaacctaactccttacgttcgggtcctaccgacggtcgtacggacggaccggtacggtccgttacgtaccttagttaccgtcggtacttcggtaccttacgagttacgttcgtcgttacgggttttcttacgttaggttccggttccgtttccgggacgggttacgggtacccgtaaaggtccggtaacccgttccgttacggtaccgtaccggacccgtaacggtcccgtcccggtacccccgg

SEQ ID NO: 272045 - DNA, 636 bp, Homo sapiens
  misc_feature: GYAE6OF02GTLBF.13.39.D06.1.454.CMB.1.raw
  modified_base (244)..(244): a, c, t, g, unknown or other
  misc_feature (244)..(244): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatgacccagtctccagactccctggctgtgtctcgtggcgagaggccacatacaactgacaacgtccgagaccagtagttcgttttanacagctaccaacaataacgaacttcttacgacgttacgtaccagacgaagaaaccgaggacacgccctacctaagcctgctactaatttacgtgggactacgtactacgtaccgggtaaccgtacccggggtccctacggaccgtagttccgtaggtacggcgtacgggtccgggtacgtggggactaggtactttacaccgtctacgaacctactacgacgacacgtcctgcgacggtctagtaacgagtcggtacgtcgttacgtttaactacgtgtaacacgtaacttaaattattataacgtacctaccttacggacgtcgtaaccttacggttccgggaacggtaacggacgtaagggtcgtaacgtactaacgaacgtacggtcgg

SEQ ID NO: 272046 - DNA, 517 bp, Homo sapiens
  misc_feature: GYAE6OF02F2FMT.13.39.D06.1.454.CMB.1.raw
  modified_base (415)..(415): a, c, t, g, unknown or other
  misc_feature (415)..(415): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccagggacagacagccagcatcacctgctctggaaataaattggcagataaatatacttcctggtattcagcagaagtcaggcccagtccccctgtcgctggtcagtctatcaaagatgcccaaagcggcccctgaggggactcccgtgaaggcgatttcctactggcctacaactctgggaactcagccactctcgaccactcagccgggacccaggctagngatgagctagactattactgtcgaggcgtgggacagcagcacgtcgcccgctactgtccttcgggaactcgggaacctacgggtccctaccggtcctaacgg

SEQ ID NO: 272047 - DNA, 680 bp, Homo sapiens
  misc_feature: GYAE6OF02GYDEL.13.39.D06.1.454.CMB.1.raw
  modified_base (238)..(238): a, c, t, g, unknown or other
  misc_feature (238)..(238): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgttttanacagctccaacaataagaacttcttagcttgtacctagcagaaccaggacacgcctacctaagctgcctcactttactcgggctactcgtactccgggaacgttcccggggtccctacggaccgtacgtttcgagttcggcgaggtccggggtcgttacggggacaacgggtacgttttaccgaccttaccgtaccctaacccgaatcccgtaacggccgaacgtacccgttaggcccgaagggtccgtaaggaaaccgtagttacggtacggtacgttaagttttaacgttaacgttacggtactaacggtctaaacttaagtttaacgtaacgttacccgttacccgtaccgtacggtacccttacgttaacccgtttcggggaccggtaacgggaccgtaacggtcggaacgtaacgtacgtaaaccgtacgttacggg

SEQ ID NO: 272048 - DNA, 679 bp, Homo sapiens
  misc_feature: GYAE6OF02G3XD8.13.39.D06.1.454.CMB.1.raw
  modified_base (233)..(233): a, c, t, g, unknown or other
  misc_feature (233)..(233): n is a, c, g, or t
tcagtcacgtactacacgaccggtgctcgatttagtgacatctcgcagttctttgggggctacaacaggcaggcagggcagcaagatggtgttgcagacccaggtcttcatttctctgttgctctggatctctggtcgcccgacggggacatcgtgatgacccagtcctccagactcccgtggctgtgtctctgggcgagacgggccacctatacaactgacaacgtccgacnccgaagagttagttttaacaacgagtcctaacccaaataaagtaaagtaaacctttcttaagtcgttacggtaaccaacgacgaagaaaacccgaaggaaccaacggtccttaaccctaagcttacgactactaacgtttacgcgggactagtccttaacggtaccggggtacgtacccgggtccctaggaaccgtacttagtacggtcgactagggccgggtcgtagggacaggtcttcgaactcgtaccacgtaactacgacgcgacgtcacgcgacggtacgaaggttaacaggttcgtgtaaccgttagtttaattacgttacggtactacgaacttaagttaaacttatagttaccctaccgtacgacggtaccgtctaacggttccgggtacgaacggggaccctaagggtcggaacggtactacggaaacgtacgtagg

SEQ ID NO: 272049 - DNA, 563 bp, Homo sapiens
  misc_feature: GYAE6OF02F99R1.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaacaataagaacttcttagcttggtaccagcagaaaccaggacagcctcctaagctgctcatttactgggcatctatccgggaactccgggtcctgaccgattcagtcggcaggcgggtctgggactagtactttcacgtctcaccatcagtcagtcctgcgtaggctagaacgtagtggtagctagttttaacttacgttgtacagtactaaattattaattaggttacctccgttaccgacggtccttcgtaacgtttccgggacggacgggtaaccgaagggtcggaagtacgtaccgtaacgtacgttacgg

SEQ ID NO: 272050 - DNA, 556 bp, Homo sapiens
  misc_feature: GYAE6OF02F5JFO.13.39.D06.1.454.CMB.1.raw
  modified_base (313)..(313): a, c, t, g, unknown or other
  misc_feature (313)..(313): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgtttatacagctaccaacaataagaacttctagcttgtaccagacagaaaccaggacagcctactaagctgctcactttcgnggctatctacgtccggaactccgggtcctgaccgattcgagtcggcaggtcgggtctacgggacagtacgtttcacgtctcaacctatccgaagcgacgtcctgacgtacgcgtagaagtcgtggtcgtacgttagtttaatacttgtacgtagtactaattattaatacgtacctccgtacgagtacgtcgtacgttcggacggtacggacgaggttacgaagtactacgtaaccgagtcgg

SEQ ID NO: 272051 - DNA, 537 bp, Homo sapiens
  misc_feature: GYAE6OF02FW6KE.13.39.D06.1.454.CMB.1.raw
  modified_base (235)..(235): a, c, t, g, unknown or other
  misc_feature (235)..(235): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgtttanacagctaccaacaataagaacttctagcttggaccagcagaaccagacagcctctaagctgctcatttactggcatctatccgggaatccgggtcctgaccgattcgagtcggcacgcgggtctcgggactaggtatttcacgttctacacctatcagcacgtcctgcaggctagaagatgtggactagtttatactgtacgagtactaagttattatacgtaccttcctaccgacgtcctcgtacgtttcgggaccggtaaggacccgtaggtcggaacgtactaacgaaccgtagtacgg

SEQ ID NO: 272052 - DNA, 836 bp, Homo sapiens
  misc_feature: GYAE6OF02FKCCN.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgaccccagtctccagactccctggctgtgtctctgggcgagacgggccaccatccgaactgcaagtcccagccagtagttgttttaactaccagcctaccaaacaaataacgaaccttttcttacgtcttcgggtacccagtccaaggaaaacccagggtaccagaccctaccgtaaacggtcttacggccttacctaactttttaaccgtgggggtaccacgtttccgttaacgttaccccgggggggtaaaaccttcccccgggggggtttacccccttacgggaaaccccggttaagttttaccccgtaaggtttaccggggcccgtaaggggtccccggggggtttacccggttcggggggaaaccgttaaacgggtaaccgttttttaccccggaacccttttacccgtaccccgtaaaccccctaacgtttaacccggaccgggtacccgtaaccggtccccggtttaacggccccgtaaagggttcccgtaacggtaaagtaacgtggttacggcgttaacgttttacttaacgttgtacagtaactaaagttatttaaacgtacgttaccctaccgtaccgaggtacctaacccgtacggtttcccggggaacgggtaccgggaaccgtagggttacgggtaagaccgtaacggtaaccgtacgttacggg

SEQ ID NO: 272053 - DNA, 560 bp, Homo sapiens
  misc_feature: GYAE6OF02FNMHD.13.39.D06.1.454.CMB.1.raw
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
  modified_base (404)..(404): a, c, t, g, unknown or other
  misc_feature (404)..(404): n is a, c, g, or t
tcagtcacgtactacacgaccggtgctcgatttagtgacatctcgcagttctttgggggctacaacaggcaggcaggggcagcaagatggtgttgcagacccaggtcttcattttctctgttgctctggatctctggtgcccacggggacatcgtgatgacccagtctccagactccctggctgtgtctctgggcgaggacgggccaccatccaactgcaacgtccagccagtagttgtttanacagctccaacaaataagaacttctagcttggaccagcagaaaccaggacagcctctaagctgctcattacnggcatctacgtccgggaatcccgggtcctgaccgtattcgagtggcaggcgggtctgggacagtattcactctcaccatcagcagtccngcaggtctagaagtatgtaggcttaagtttacttacgtgtaccagtacttaattattacgttagtaccttccgtacggagtcctacgtacgtttaccgggacgggtaacggtaaccgtagggtacggtaagtaccgtaacggtaaacgtagtcggg

SEQ ID NO: 272054 - DNA, 643 bp, Homo sapiens
  misc_feature: GYAE6OF02HPDNR.13.39.D06.1.454.CMB.1.raw
  modified_base (243)..(243): a, c, t, g, unknown or other
  misc_feature (243)..(243): n is a, c, g, or t
  modified_base (331)..(331): a, c, t, g, unknown or other
  misc_feature (331)..(331): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccatcggctgtgtctcgtgggcgaggacggccaccatcaactgacaacgtccagccagtagttgtttanacagcctaccaacaaataagtaactttcttagcttaggtaccagacaacgaaaccaggacagcctacctaagctgctactatttacgnggcatcgtacgtccggggaacgtcccggggtacctaggacccgtattccgaggtcggacagggtccgggttacgtacggggactagttactttacaccttcctaccacctactacgagtcgacgtccgtacgggcggtacgtaggaagtagtggtaggtacttagttttactacgttcgacgaagtactaattaattactaacgttacctccgtaccgtacggtacctacgtaccggtttccgggaacgggtaaccgggtaacggtaacgggttacgggaacgtaacgtaaccgtaaacggtacgttacggg

SEQ ID NO: 272055 - DNA, 576 bp, Homo sapiens
  misc_feature: GYAE6OF02H5DHX.13.39.D06.1.454.CMB.1.raw
  modified_base (263)..(263): a, c, t, g, unknown or other
  misc_feature (263)..(263): n is a, c, g, or t
  modified_base (525)..(525): a, c, t, g, unknown or other
  misc_feature (525)..(525): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctcagtgtcccgtcgtccccaggacagacacgccagcatccacctgctctaggaaataattggacagataatatacttcctggtacncagcagagtcaggccacgttcccctgtcgtctggtctatctatacaagatcgaccaacggccggccctcgacgggtactcccgtagacgtcgtacttccgtcgtcggtcctacccgtaacgtcgtacggaacctcgacgtccctactcgtacgacctactacgacggaccggaccgaggtactacgtaggacgtcggacgtctacgacgttattaccgtagtcgagggtcggtacggaacacgcgagccgtcgtcgcccgtntacgtcgttacgtacggacgtcggaacctacggtacctaccgtacgtaacg

SEQ ID NO: 272056 - DNA, 665 bp, Homo sapiens
  misc_feature: GYAE6OF02HHW77.13.39.D06.1.454.CMB.1.raw
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (330)..(330): a, c, t, g, unknown or other
  misc_feature (330)..(330): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactcctggctgtgtctcgtgggcgaggacgggcccaaccatcaactgcaacgtccagccagagttntttanacagctaccaacaataagaacttctagtcttggtaccagcaagaaaccaggaccacgcctaccgtaagcctgcctactactttacgnggctatacgtacgtaccgggaactcccggggtacctacgaccgtattacgaggttcggcgtaggtccgggtactgggactagttactttccgacttcctacctaccgtatccgacgacgtacgccgtacgcgacggtactaaggaacgtacgtggtcggttaacttaagttttacttacgtacgtaccgaacgttaacttaaagttactttaacgttaaccgttacccgtccgttaaccggtacggttcccttacggttacccggttaccggggaaccggtaaccgggtaacccgtaagggttacggaacgtaaccgtaacgaaaccggttacgg

SEQ ID NO: 272057 - DNA, 721 bp, Homo sapiens
  misc_feature: GYAE6OF02G7R4Y.13.39.D06.1.454.CMB.1.raw
  modified_base (353)..(353): a, c, t, g, unknown or other
  misc_feature (353)..(353): n is a, c, g, or t
tcagtcacgtactacacgaccggtgctcgatttagtgacatctcgcaggttcgtttgggggctacaacaggcaggcaggggcagcaagatggtgttgcaggacccagggtcttcatttctctgttgctctggatctctggtgcccgacggggacatcgtgatgacccagtctccagactccctggctgtgtctcgtgggcgaggacgggccaccatcaactgacaacgtccacgccagtagttgttttatacagcctaccaaacaaataacgtaacttcttagcttcggtacccagtacaacgaaaccgaggtaacacgtccctacctaaacgctgccttctaacttttacgngggtactacttctaacggtccgggtaacgttcccgggtaccctcggaaccgtacttcgaggttcggacgtacgggtcgggttcgtacggggaccaacggtttacttccacgttcctacctacctactcgacgcgacgtccgtacgcgacggtctaggaacgtacggtcggtacggtacgtttaacgtttagttacgtcggtactagtacttaaattacgttttaagtaaccgttaccttacccgtaccggttacggtccgtttaaccggtttaccggtttccggggtaaccggggtaaccgggtaacgggttaacggggtacggtaaccgttaacggtaaacccggtaaacggttaacggttacgggg

SEQ ID NO: 272058 - DNA, 687 bp, Homo sapiens
  misc_feature: GYAE6OF02IV2O8.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgaggagggccaccgatcaactgacaacgtccagccagagttgttttacacagcctaccaaactaataacgaacctttctagcttacggtaaccagacaacgaaacctaggaaccacgtacctacgtaagctcgtctactactttacgcgggactacgtactacggtaccgggaacgttcccgggtccctaggtaccgtattccgaaggttcggaccgagggtccgggttcgtagggaacctagttaacgttttccaccgttacctacgaaccctacgttcgaacggtccgacggtacctcggaccgtaacggtcgttaaggaagtcttcgggtacgtacgtttagtttacttacgttacgtacgaacgttacaagtttacttagttaaccgtaccgtacccgttacggtacgttacctacggttaccggttacgggaccggtaacgggaacgtacgggtacggaactacggtaacgtaaccgagttaccggg

SEQ ID NO: 272059 - DNA, 619 bp, Homo sapiens
  misc_feature: GYAE6OF02HY2FW.13.39.D06.1.454.CMB.1.raw
  modified_base (139)..(139): a, c, t, g, unknown or other
  misc_feature (139)..(139): n is a, c, g, or t
  modified_base (249)..(249): a, c, t, g, unknown or other
  misc_feature (249)..(249): n is a, c, g, or t
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtncccgacggggacatcgtgatcgacccagtctccagactccctggctgtgtctctgggcgagacgggccaccatcaactgacaagtccacgccagagttgtttaactacgngtctaccaaacaaataacgtaactttcttagtcttggtaccagcaagaaaccaggacacgtcctcctaagctnctctactttacgnggcatctagtccgggtaacgtcccggggtcctcgaccgtattcgacggtggcnggcgggtcgacgggactagtatttcactcttacactactacgacgtacgcgtcccgtcgacgtacgggcgttaaggtaacggtattagggtcggtacggtttacgttttaagttacgtttacgtactaacggtaacttaagttaattagttacgtcctaccgtcggtacgtcttccgttaccgttcgggaccgtagggtacgtaacgggtgtaacgactacgaagtaacgg

SEQ ID NO: 272060 - DNA, 654 bp, Homo sapiens
  misc_feature: GYAE6OF02HSBHB.13.39.D06.1.454.CMB.1.raw
tcagtcacgtactacacgaccggtgctcgatttagtgacatctcgcaggttctttgggggctgggcctacaggaagcagcatcggaggtgcctcagccatggcatggatcccctctcttcctcggcgtccttgcttactgcacaggatccgtggcctcctatgagctgactcagcccaccctcagtcgtaccgtgtaccccaggaccagaccagccagcatccacctgcctcgtaggaaattaagttggacaagtactaaatatacttctggtatcagcagaagtcacggccctacgtcccctagtcgcgtggtcatctatcaagtctcgaccgtaagccggtcccgtacgacgggtactcccgtgacgcgtacttctcgtcgtcctacctacgtcgacgggtaacctccgacgtccctactccgacgaacctatccgacgggacccggaacccgaggtactagtggtacgtcggacgtcctacgtaacgttacgtacgtcgtacgacgggttcgtacgggtacgaccgtaccggactaccgaccggttcccggacccggtacgttaacggtacccgtttccggttaaccgggtaacccggttaacgggaacccggtaacgggttacccgtaccccggtttaccgtaacccggg

SEQ ID NO: 272061 - DNA, 681 bp, Homo sapiens
  misc_feature: GYAE6OF02GSSGX.13.39.D06.1.454.CMB.1.raw
tcagtcacgtactacacgaccggtgctcgatttagtgacatctcgcagttctttgggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctctgcactggaacagcagtgatgtggtgtatactatgtctctggtacacacaccgagacaaacgccccaaatctaagttacgttacgggtacaagtacggcgaccctacgtacggtctttacgtacgacttcgtcttaccgtctcggtacctaccgtaacgttcgtacgggtaccaaaccggtaacccggtcccttaccccgtaggtaacctaacgttccttaccggtacggtaccgtacccgtaacgggcccggtaacggggaccgtacgggtaccgtttaggtttacgtttttacgtgtttacgttacctaagttactcggtaacggtaagggtaaggtacgtaggtaatttagtcgttagttaggggaacgtcgggtacgtacggtaccgtaccgttccggttacggtcccgaaccggtacccgaacggtacccccaacccgttacgtccgtacctacgttacccg

SEQ ID NO: 272062 - DNA, 785 bp, Homo sapiens
  misc_feature: GYAE6OF02IQJW6.13.39.D06.1.454.CMB.1.raw
  modified_base (243)..(243): a, c, t, g, unknown or other
  misc_feature (243)..(243): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatgacccagtctccagactccctggctgtgtctcgtgggcgagacgggccaccatcaactgccaacgtccagccagtagttgtttanacagcctacctaacaaataacgtaaccttacttaagcgttacggtaccagtacaacgaaaccaggaccacgtcctaccgtaagctgctctaatttacgcgggtactagtctaacgtaccggggaacgttcccgggtaccctcgaaccgtacttacgtaggtacggtcgacggtcgggtcgtacggggaactagtaacgtttcctacgttcctacgtaacctaagtcctaaggcctaaacgggcccttcggtaccgtacgggtacctaagggtaacggtacggttaaggtaccggggttactttaaccggttttaactttaaccggttacgttaaaccggtaacccggttacgttaaaaaccgttttaacgttttaaaccgttaaacggtttaccccgttaacccggttacccgggtaacgggtttcccgttaaccgttttacccggggtttaaccggggtacccgggtaaccgggtaacccgggtaaggggtttaccggaacggttaactaaacccgggttaaaacggaccggtttacgggg

SEQ ID NO: 272063 - DNA, 823 bp, Homo sapiens
  misc_feature: GYAE6OF02J21F0.13.39.D06.1.454.CMB.1.raw
  modified_base (173)..(173): a, c, t, g, unknown or other
  misc_feature (173)..(173): n is a, c, g, or t
tcagtcacgtactacacgaccggtgctcgatttagtgacatctcgcagttctttgggggctacaacaggcaggcagggcagcaagatggtgttgcagacccaggtcttcatttctctgttcgcttctggactctcgtggtcgcccgacggggacagtcgtgactacgacccgngttcctccacgtacctcccgtggcctggtcgttccgtcggtagggcggtacggccgggaccaccgactaccaacgtcggactaacgtccgaacgcctaggttacgttcgttttaccacgtaccgtaccgtaaccccaaagtaaacgttaacttaaccgttcgttacggtaccgtttaccggaacgacggaacctaaccggaaaccgacggtaccaccgttaccctacgttaacgcttacgtacttacgtaacgtttacgcggactacgtaccgttaccggtacggtaccgtcccggtccaccgtacgttacttcggaggtccggtacgtcgggttaacccggtaggtaccgggtaactacgtttcccgtaccaccgttacgacccacgtacgtaccggactaccgtacgaccgtcggtaacggcgttcgaacgtaacggtcttacggtaccgggtttacgtttaacgtaacgtttcgaacgttcccgaaagttaccttaacgttacgttaaaccgttccggtacccgttaccgacgggttaccttacccggggtttaacctcgggggtaaccccgttaacgggacggtttaacccggaggggtttaccaaaacccggttacgtaaccccggtaaggttaccgtaaccggg

SEQ ID NO: 272064 - DNA, 535 bp, Homo sapiens
  misc_feature: GYAE6OF02HDTB1.13.39.D06.1.454.CMB.1.raw
  modified_base (235)..(235): a, c, t, g, unknown or other
  misc_feature (235)..(235): n is a, c, g, or t
  modified_base (310)..(310): a, c, t, g, unknown or other
  misc_feature (310)..(310): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacgaggacatcgtgatgacccagtctccagactccctggctgtgtctctgggcgagaggccaccatcaactgcagtccagccagagtgttttanacagctccaacaataagtaacttcttagcttggtaccagcaagaaaccaggacagcctccaagctgctcattacnggcatctagtccgggaactcccggggtccctggaccgtattcagtcggcaggtcgggtctgggactagtactttcactctcactatcagcgagcctgcgacgtctagaagtagtgtgcgttagtttacttacgtgtacgagactaattagttattacgtacctccgacgtacgtcctacgtacgttcggacggtacggacgtaaggtggagacgtacgaagtacg

SEQ ID NO: 272065 - DNA, 607 bp, Homo sapiens
  misc_feature: GYAE6OF02H5AHB.13.39.D06.1.454.CMB.1.raw
  modified_base (467)..(467): a, c, t, g, unknown or other
  misc_feature (467)..(467): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggaccagacacgccagcatcacctgcctacgtaggaaaataagtggacaagaataaatattaccttaccgtaggtatactagcagaagtacgaggccacgtcccctgtcgctggtacactactagtactaaagatacgaccaacgtccggacccgttacgacgggtactccctagacgcgactttcgtcgtcggcctacctaactcgtacgggtaacctcgaccgacctacttccacgtaccatacgaacggccggaaccgagaccgttanacgggtatacggaggtactacgtacttagttactacggtacagggtcgtacggacgaagcagaccaccgtcgacccgtattacgtacgttaccgtacggttaccgacgggtaacccgacggtaccgtaccgtacctaacg

SEQ ID NO: 272066 - DNA, 814 bp, Homo sapiens
  misc_feature: GYAE6OF02FTIKJ.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttcgtctgttgctctggatctctggtcgcccgacggggacatcgtgatcgacccagtcctccacgacctcccgtggctgtgtctcgtgggcgaggacggccacgataccaactgacaacgtccagccgaaggtagtttacgttttaacacgtacgacctaaccaaaactaaacgttaaacgtaaccttttcgttacgtaccgtttacggaacccaaggtaaccaaacggaaaacccgacggaaaccgtaccgtaccccttaaccgtaaacgccgttacggaccttacgttacgtttaccggtgggtacctacttacggtaacgtaccggggtaaccggttccccgggtacctacggaaccggtcttacggacggtcgggtaccgtacggggtaccgggttacgtacggggaaccttaacgggtttacctttaccgtaccttaccgtaccctaaacgtaccgtaccgaacgtaccgtaccggtcccggttacgaaccggacggttaacggtagtaacggttcggttacggttacgttacgtttaacgttttacgacgttacgtacgtaacgtacttaaagtttactaacgttaccgttaccgtaccgttacggtaccgtaccgtttaccggtacggttaccggggaccggtaacggtaaccggtaggtacggaacgttaacgtaaccggtaacgtcggtacgg

SEQ ID NO: 272067 - DNA, 624 bp, Homo sapiens
  misc_feature: GYAE6OF02JED9G.13.39.D06.1.454.CMB.1.raw
  modified_base (179)..(179): a, c, t, g, unknown or other
  misc_feature (179)..(179): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatcacctgctctagaaataatgcagataatatactctgtatcagcagacgtcaggccacgtccctgtcgctggtctatctatacaagatcgaccgaggccggccctacgaacgggtctcccgtagacggacgtacttcgtctcggtcctaccctacgtcgtcgggtaactcgacgtccctacgtcctagacccagtacaccggacccgggaacccgagggtccgtaacgtacgggtagtcgggaacggtcgttaccgtaacgttacgtttacgtcggtacgtacggggtccggtacggaccgacggtacgacgtccacgtccggtaccccggtattacggttccgtttaccggttacgggtaaccggtaccgggtaacccggtacggtaccccgttacccggtacgtaacccgg

SEQ ID NO: 272068 - DNA, 504 bp, Homo sapiens
  misc_feature: GYAE6OF02F3LYN.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgtttatacagctccaacaataagaacttcttagcttggtaccagcagaaaccaggacagcctcctaagctgctcattactggcatctatccggaatccgggtcctgaccgattcgagtggcagcgggtctgggacagatttcgactcgtcaccactcagcagcctgcaggctgaacgatgtgactagtttatacttgtcagctaatattatagtacttccgtcgagctctacgtttacggcggtacggacgaggtgaggatacgtaacgatacgg

SEQ ID NO: 272069 - DNA, 563 bp, Homo sapiens
  misc_feature: GYAE6OF02I9WX3.13.39.D06.1.454.CMB.1.raw
tcagtcacgtactacacgaccggtgctcgatttagtgacatctcgcagttctttgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctctgtaccaacacaccaggacaacgaccccaaatcatgtattatgatgtacagtacgccgtccgtacgacgggtcctagactcgtcttctctcgcctacacgtctcggacaccgtccgccctccgtacgacctatccgtcgtcggtcctccgaggtccgtaggagtacgtgtacgtcgtatacttacttacgtgtacctcgtacttactagttacgcgacgacgcgtacgtacctactacgttacgttactacggtcggacggtacggaccgtacgtccgtacgaccggttaccgtacgtacccg

SEQ ID NO: 272070 - DNA, 631 bp, Homo sapiens
  misc_feature: GYAE6OF02GZKHN.13.39.D06.1.454.CMB.1.raw
  modified_base (349)..(349): a, c, t, g, unknown or other
  misc_feature (349)..(349): n is a, c, g, or t
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccgacggggacatcgtgatcgaccagtctccagactccctggctgtgtctcgtgggcgaggagggcccaccataccaactgacaacgtccacgccagtagttgttttatacagcctaccaaacaaataaacgtaacctttacttagtccttaggtaaccagaccaagaaaaccacggacacgccctacctaagctgctactatttacgnggctactctagtccgggaacgttcccggggacctgaccgtatttcaggtcggcacggcgggtctagggactagtacttcactctaccacatcagtccacgcctgacncggtcagagtntcggtggtacttagtttactacgtgtacgtagtaacttaattaactttaagtcgttacctccggtacggtacgtaccgttaccgttaaccggtttcggggaaccgggtaacggtaaccggtaacggggtacggtaacgtaacgttaaccggaaacggttacggg

SEQ ID NO: 272071 - DNA, 578 bp, Homo sapiens
  misc_feature: GYAE6OF02JJLLM.13.39.D06.1.454.CMB.1.raw
  modified_base (321)..(321): a, c, t, g, unknown or other
  misc_feature (321)..(321): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctcgtgggcgagacgggcccacatcaactgcaagtccagccagagttgtttaacacagcctccaacaataagaacttcttaagcttggtaccagcagaaaccaggaccagcctacctaagctgctcatttacgnggacatctagtccgggaatccgggtccctacgaccgtattcagtggcagcgggtctgggacaggtatttccactcctacaccactacgacgcacgcctgcgacggctgaagatgtcgacgttagtttacgttactcgtcacgtactaattattaacttacgtaccgttaccctaccgtacgcttaccgtacgtttcgggaccgggtaacggaaccgtagggtacggacgtaacggtaacctaacggtacttaacggg

SEQ ID NO: 272072 - DNA, 946 bp, Homo sapiens
  misc_feature: GYAE6OF02F10F5.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtggcgagacgggccaccatcaactgcaagtccagccagacgttgttttactacagcctaccaaacgaaataagtaacctttcttaggtcctttacggtaacccaggaccaacgaaaaccctaggaacacggacccttaccgtaaaacggccttggacctttacgtaactttttaaccggtcggggtaacctaacgtttaccgttaacggttaccccgggggaaaagtttccccccggggggttacccctacggtaaaccccggtagttttaacccggaaggggttacgggaccgtaacggggttcccgggggttacccggttaggggggaaacccttaacgggtttaaacgtttttaccccggtaaaccggtttacccgttaaaccctaaacccccggttaaacgtttaccccgaaacggggtaacccctaaaccgggtacccccggtttaaccgggtaccgaaaaccgggggttacccggtttaaaccggaaaaagggtaaaccggtttgggtaaccgggggtttacccttttaaagggtttttttaaaccttaccggtttacgtaccgtaacggggtaaacccttaaagtttaaccgttttaaacgtttaaccgtaccgtttaccccgtacgggtaacgtcccgttaacccggttaaccggttttaccggggaaccgggtaaccgggtaaacccggttaacggggtacggtaaaggtaacccgtaacccggtaaaacggtacccgttaacgggg

SEQ ID NO: 272073 - DNA, 684 bp, Homo sapiens
  misc_feature: GYAE6OF02FJVO1.13.39.D06.1.454.CMB.1.raw
  modified_base (247)..(247): a, c, t, g, unknown or other
  misc_feature (247)..(247): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctcccgtggctgtgtctcgtgggcgaggacgggccaccatccaactcgcaagtcccagccagtagttgttttanactgcctccaaacaataagtaaccttcttagcttcggtaccagcaagaaacccaggacagcctacctaagctcgctactattacgtgggactacgttctagtacccggggtaagtcccggggtccccttacggaaccgtatttccgaagggttcggaccgaggttccgggggtcgtacgggggtactaacggtacttttcccgacgttaccttacccgaacctaacacgtacgcacgtcccttaggaccgacggtacctaggaagtagttgtaggtactaacggttttacgttaccgtagttaccgagtacgtaaattacgttaataccggttacctccggtaccgacggtccgttaaccgtacggttttacccgggacgggtaacgggtaccgttaagggtacggagttaaccgtaacgaaaccggtacgttacgg

SEQ ID NO: 272074 - DNA, 602 bp, Homo sapiens
  misc_feature: GYAE6OF02HZIYV.13.39.D06.1.454.CMB.1.raw
  modified_base (253)..(253): a, c, t, g, unknown or other
  misc_feature (253)..(253): n is a, c, g, or t
  modified_base (348)..(348): a, c, t, g, unknown or other
  misc_feature (348)..(348): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtcgcccgacggggacatcgtgatcggacccagtctccagacctccctggctgtgtctcgtgggcgaggacggccaccatccaactcgcaacgtccagaccagtacgttgttttaanacgagtcctaccaaactaaataagaacctttctaagacgttaggtaccagacaacgaaccaggacacgtcctactaagctagcctctaattacgnggctatctacgtccggacgtcccgggtcagaccgtatcgaggtcgacgtgtcggtacgtcggactagtacttcaaccttcacctaacntacacgacgacnccgtgactcggatacgaagtagttcggagtacttaaacgtttagtactacgttacacgttacttaaattcgtaagtacgttaccgtccgtcggtaacgtcgttacgtacgttccggggagtacggacgtaaggcggtaacactaccgaagtcgg

SEQ ID NO: 272075 - DNA, 891 bp, Homo sapiens
  misc_feature: GYAE6OF02HYYSA.13.39.D06.1.454.CMB.1.raw
tcagtcacgtactacacgaccggtgctcgatttagtgacatctcgcagttctttggggagctacaacaggcaggcaggggcagcaagatggtgttgcagacccaggtcttcatttctctgttgctctggatctctggtcgcccgacggggacatcgtagatcgacccagtcctccagacctccctggctgtgtctcgtgggcgaggacgggccacatcaactgacacgtccacgccagtagttgttttaacacgacgtcctacccaaacaaattaaacgtaacttttacgttaacgtacgttacggtaaccacgtacaaacggaaaacccgaagggaaccacggtaccccttaccgtaaggtccttacggacctttacgttaacctttttaacggtgggtacctacgttaccgttaaacgggttccccgggggtaaaacccggttcccccgggggttaacccctcgggtaacccggttacgtttacccggttaacgggtcgggtaccggtacggggttcccgggggttacgggttcggggtaaacctgggtttaacccttttccgaacccgtttcctaccccgtaactaccgttacgaacgtcccgtaaccgtcccgttaggccggttaacgggacgttaacgggaaacggttagtcgggtaccggttacggtttaaacgtttttaaagtcccgttagggttaccgaacggttaaactttaaacgttaaactttaaacgttaccggtttaccccttaccgggtaacggttacccgggtaccttttaacccggttaacccgggtttaacgggggccgggttaaaacccggggtacggttaaaccggggtggaaaaccggtttaaccggtaaaccgtaaccgggtaacccggg

SEQ ID NO: 272076 - DNA, 675 bp, Homo sapiens
  misc_feature: GYAE6OF02HEJE0.13.39.D06.1.454.CMB.1.raw
  modified_base (315)..(315): a, c, t, g, unknown or other
  misc_feature (315)..(315): n is a, c, g, or t
tcagtcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccacatcaactgcaagtccagccagtagttgtttatacagcctaccaacaataagaacttcttagcttggtaccagcaagaaaccaggacagcctcgtaagctgctcatttacngggcatctacgtccgggaacttccggggtccctgaccgtagtttccgaggttcggacgacggtcggggtacgtaggggacctaggtactttacgtacccgttactccgtaaccctacgtacgacggtaccgtaacgcccgttacggaccggtacggtaccgtaggaacggttaagtcgggtacggtacgttaggttttaacttaccgttgtaccgtaagtactaaagtttaacttaagttacgttaccgttcccgtaccggtacggtacccttaccggtttaaccggtttacggggaccgggtaacgggaacccggtaagggtacggtaacggtaacgttaccggaaacggttaaccggg

SEQ ID NO: 272077 - DNA, 812 bp, Homo sapiens
  misc_feature: GYAE6OF02I2LQN.13.39.D06.1.454.CMB.1.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacgggacatcgtgatgacccagtctccagactcccgtggctgtgtctcgtgggcgagnggccaccatcaactgacaagtccagccagagttgtttanaccagcctaccaacaataagtaacttcgttagtcttacggtaacccagacaacgaaaacccgaggaaccacggtccctaaccgttaaacggccgttcggacctttacctaacgtttttaacggccggggtactaacgtttacgtaaccggtacccggggtaaacggttcccccgggggttaaccctacgggtaacccggttaacgtttaccggtaacggttacggggaccggtaacgggtaccgggggttcgtaacggggtaaccgtacgggtttaacttttaccggtaacctccttaacccgtaaccctaacgttacccgtaacggaccgttaacggcccgttaggaaccgcggttacgtaacggtaacgagttacggtacggtacctttaagttttacgttacgtacgtactaccgtaacttaaagttaacgtttaacgtaacgttaccgttcctaccggtacggtaccttacccggtaacggttttacccgggacggggtttaaaccgggacccggtaaaggggtttacggaacgtaacccggttaaacgtaaaccggtacggttaacggg

SEQ ID NO: 272078 - DNA, 796 bp, Homo sapiens
  misc_feature: GYAE6OF02H1Q31.13.39.D06.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctggctcagtctgccctgactcagcctcgctcagtcgtccgggtctcctggacngtcagtccaccatcctcctgcacgtaggaacngctagtgattcgttggtacttatacgtacttcgttctccgttcggtaacccaacctaccccgaacccgacggaccaacccgggtccccccaaggtacggtacctaacgttaccttaagtttacggtacgggggtactaaacggtacgggtccgggtacccggtacggtaacgggttacctttacccgtaccggttccgttcctttaccgttcgttccggtaccttacccgtaaacggttccgtaccggtaaccgtaacccggtacccggtcccccgttaccccgttaccggtaacccttaaccgtttccccggtttccggtacccgggggttaccccttacccgggtacggggtcccttacggggtaacggttaccggtacggttaaccggttcgtttacgttaaacgttttacgtaccgtttacggccgtttacggtaccctttacgtagtacgttacgcgaacggtcctacgttctaccgttcgttacgtacgttaaccggtcgggaccggtaacggaccgtacgaccggttccgtacccggttcgtaccggtcaacccggg

SEQ ID NO: 272079 - DNA, 768 bp, Homo sapiens
  misc_feature: GYAE6OF02IVDDG.13.39.D06.1.454.CMB.1.raw
  modified_base (253)..(253): a, c, t, g, unknown or other
  misc_feature (253)..(253): n is a, c, g, or t
  modified_base (365)..(365): a, c, t, g, unknown or other
  misc_feature (365)..(365): n is a, c, g, or t
tcagtcacgtactacacgaccggtgctcgatttagtgacatctcgcagttctttggggggctacaacaggcaggcagggggcagcaagatggtgttgcagacccaggtcttcatttctctgttgctctggatctctggtgcccgacgggggacatcgtgatgacccagtctccagacctccctggctgtgtctcgtgggcgaggagggcccaccataccaactcgacaacgtccagccagtagttgttttaanacagacctaccaaactaaataacgtaactttcgttaacgtcgttcggtaccagaccaacggaaacccaggaccacggccctacgtaagtcctggtacctacgtagtttacgngggtactattccgtaacgtaccgggtaacgttcccgggtaccctagaacccgtcttacgacggtcggacgtacgggtcggggttacggtcgggaacgtagtttaccgtttccaaccgttccgtacctaacctacgtacaccggtcaccggcccgtacggaccggacgggttacgtaggtaacggttagtacgggtacggttacgtttaacggtttacttacggttcgtaaccggtaagtaacgttaaactttaagtttaaccgttaaaccgtaccgtttacccggtaccggtaacggttacccttccggttaaccgggtttaccggggacgggggtaaccggggtacgggtaacggggttacggtaaccggtaaccggtaaaccgtaacggtacgttacgggg

SEQ ID NO: 272080 - DNA, 662 bp, Homo sapiens
  misc_feature: GYAE6OF02JY92K.13.39.D06.1.454.CMB.1.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (503)..(503): a, c, t, g, unknown or other
  misc_feature (503)..(503): n is a, c, g, or t
  modified_base (563)..(563): a, c, t, g, unknown or other
  misc_feature (563)..(563): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatcgacccagtctccagactccctggctgtgtctcgtgggcgaggcgggcccaccatccaactcgacaagtccacgccagtagttgttttaanacagtacctaccaanaaataacgtaacttcgttaacgtcttacgtaccagcgaacgaaccaggtacacgacctaccganctgtactctacgtttacgnggtacattacgtacgtaccggggtaacgttccccgggtaccctacgtaaccgtagttacgaggtcggacgtaacgggtcgggttacggtcggggactaaggttacgtttacaccgttcctaccaaccgtctacgacgtccgacggtcctaggaccgnggttccgagtacggcgttgaggtacctttaggttattccgagtttacagtacttaaattnttaacgtacgtaccctccggtagtaccgtcgttaaccggtcggttaggacccgggtaaggacggttaggtacgtaacgtaccgaacggtacgtgtacgg

SEQ ID NO: 272081 - DNA, 786 bp, Homo sapiens
  misc_feature: GYAE6OF02HUGFJ.13.39.D06.1.454.CMB.1.raw
  modified_base (250)..(250): a, c, t, g, unknown or other
  misc_feature (250)..(250): n is a, c, g, or t
  modified_base (358)..(358): a, c, t, g, unknown or other
  misc_feature (358)..(358): n is a, c, g, or t
tcagtcacgtactacacgaccggtgctcgatttagtgacatctcgcagttctttgggggctacaacaggcaggcaggggcagcaagatggtgttgcaggacccaggtcttcatttctctgttgctctggatctctggtcgcccgacgggacatcgtgatcgaccagtctccagactccctggctgtcgtctcgtgggcgaggacggccaccactacaactgacgaacgtccagcctaagagtttgtttanacacgctaccaaactaaataacgtaacttcttaacgtcttacggaaccacggcaacgaaaccgaggacacggtacccttacgaagtctgtcctcttaacgtttaccgnggactacgtaccgtaacggtaccgggtaacggttccccgggtacctacggacccgtattaccgaggttccggaggtacgggtaccggggtcgttaacggggactacggtttaaccgtttacctaccgttacgtaccctaaccgttacgaacgaccgtacgtaccgtcccgtacggaccgtaggacccggtaagtaacgtccgggttacgggttacgtacgttttaacgttttaacgttaacccgttcgggtaaccgttaacgtaacgttaaactttaccggtttattaaacccggttcccgtttaacccgtaccgggtaacgttaccccgttcggtttaacccggtttaccggggaaccgggtaacccgggtaacggttacgggtacggaaaccgttacggtaaacccgtaacggttaccggtacggg

SEQ ID NO: 272082 - DNA, 922 bp, Homo sapiens
  misc_feature: GYAE6OF02JB484.13.39.D06.1.454.CMB.1.raw
  modified_base (173)..(173): a, c, t, g, unknown or other
  misc_feature (173)..(173): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggaccatcgtgatcgacccagtctccngacctccctggctgtgtctctgggcgagcgggccaccatacactcgcagtccacgccagtaggttacgttttatacacgcctaccaaacgaaattaaagtaacctttacttacggtaccgtttacgggtaaccccgtaaggacgaaacggtaaaaccccaacggggtaacccgaccggtaccccttacccgtaaacggtaccgttacgtacccgttaccttaaagtttttaacccggtcggggtaaccctagtttaacccgttaccgggttaccccggggggtaaacccggtttcccccggggggttacccccgtaaccgggtaaccccgggttacgtttaccggacggggtttacggcccggtaacgggggttcccgggggtttaccggtaccggggggtaaacccttaccggtttaacgtttttcccgtaacccgtttacccccgttaacccgaaccccgtaacgtttacccgaacgttacccgggaaccgttcccgggtagtcccggggaaacgggtcgttaaacgggaaacggtaggttaccggtacgggtaccggttttaacgttttacggtttaaccgttcggttaacctaaggtacctttaaagtttactttaacgtttacgttaccttccccgggttaccggtcgttaccctccggtttacccgggtttaccgggggcggggtaaccgggtaccggtaaggggtgtaaaccggttacaacccgttaacgtcggttaacggg

SEQ ID NO: 272083 - DNA, 686 bp, Homo sapiens
  misc_feature: GYAE6OF02IEYLF.13.39.D06.1.454.CMB.1.raw
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
  modified_base (368)..(368): a, c, t, g, unknown or other
  misc_feature (368)..(368): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagaggccacatcaactgacaagtccagccagagtgttttanacacgtctaccaaactaataaagaacttcttagtcgttgtaccagtcaagtaaaaccgngacacgcctaccgtaagctgtactcaattttactggctactctacgtacggaacgtccggtccctagaccgtntacgaggtgaccgaggtaccgggtcgtacgggactaggtctttcaacgttcctaccaacctataccagtaccgagacccgttcgaccggtaggtactacgggaaaattacgttacgggtcggtaaaccgtttagttttaactttacgttacgtaccgaagtaactaaacttttaattaacgtttaacgttacctacccgtttacccgaccgggtaccgttccggtttacgttccgggggtaaccgggtaaccggggtaaccctaaaggggtccgggtaacgtaacgtttaacccgaaaccgggttaacgtttccgggg

SEQ ID NO: 272084 - DNA, 603 bp, Homo sapiens
  misc_feature: GYAE6OF02FM71X.13.39.D06.1.454.CMB.1.raw
  modified_base (241)..(241): a, c, t, g, unknown or other
  misc_feature (241)..(241): n is a, c, g, or t
  modified_base (431)..(431): a, c, t, g, unknown or other
  misc_feature (431)..(431): n is a, c, g, or t
tcagtcacgtactacacgaccggtgctcgatttagtgacatctcgcagttctttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttanacagcctccaaacaataagaacttcttagcttggtaccagcagaaaccaggacagcctactaagctgctcatttacgtgggactatctagtcccggggtaagttcccggggtccctaggaccgtacttcgaggtcggccgtaggcggggttacgtgggacctagtactttcaccgtctccacctatcgancgacgccctagccgtacggctaggaagtagtggtaggtcttagtttattacgtcgtacagactaattaagttataccgttacctccgtaccgtacgtccttaccgttaccggtttacggaccgggtacgggtaaccgtagggtacggtagtaacgtaacggtaacgtaacgg

SEQ ID NO: 272085 - DNA, 698 bp, Homo sapiens
  misc_feature: GYAE6OF02GK5VS.13.39.D06.1.454.CMB.1.raw
  modified_base (239)..(239): a, c, t, g, unknown or other
  misc_feature (239)..(239): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgccacggggacatcgtgatgaccagtctccagactcctggctgtgtctcgtgggcgagacggccacatcaactgacaagtccagccagtacgttgttttanacgacgtcctaccaaactaaataaagtaacttacttacgtacttcgggtaaccacgtacaacgaaaaccgaggaaccacgaccctacctaacggcctagcttacgtagtttacgtgggactacttacgtacgttaccgggaacgttccgggtacctacggacctagttcgaggtcggacgtacggtcgggtcgtcgggaactacgtactttcgacttcctacaacctataccacgacctacgcctacgtcgaacggtcgtaagaacggtcgttacgggtcgtacgtttagtttaaccgttaacgttacgttccgaacggtaactttaaagttaagtttaaacgtaacttaccgttaccgttacgaggttcccttaacgttacggtttaccggggacgggttaaccgggtaccgttaacgggtacgggtaacacggtaaccgaacggtaccgttacgggg

SEQ ID NO: 272086 - DNA, 900 bp, Homo sapiens
  misc_feature: GYAE6OF02HHKUP.13.39.D06.1.454.CMB.1.raw
tcagtcacgtactacacgaccggtgctcgatttagtgacatctcgcagttctttgggggctacaacaggcaggcaggggcagcaagatggtagttgcaagacccaggtcttcattttctctgttgctctaggatctactggtcgcccgacggggacactcgtgatgacccagtctccagacctcccgtggcttcgtgtcctcgtcgggcgacggacgggacccaccgatcgaactcgacgtaacggtccacggaccgaaggtacgtttagttttaacaccgtacgtaccttaccgaaactaaagtaaacgtaaccgtttacgttaacgtacgtttacggaacccgacgtaccaaacggaaaccgtaacgggaacaccggtacccttaccgtaacgtccgttacggtaccttacgtaacgttttaccggacgggtacctacgttacccgtaacgggtacccggggtaaccggttccccggggttaccccgtacggtaacccgtacgtttaccggtacgggttaccggacggtaaccggggtccggggttacggttaccgggggaacctacgggtttacttttacccgaccgtttaccgtaccctaaccgtacgttaccgaacggttaccacggtacccttacggacccggtaggttaccgtaaggaacggttagtacgggttcgacgttttaaacggtttacgtttaccggtcgtacgaacgttaaccgttaaagttttaccgtttaaacttaccggttacccgtttacccgggtaccggttaacgttaccccggtttaaccgtttaacccgggtacgggggaaccgggttaacccgggtaccgttaacggggttaccgtaacggtaaacccgttaaccggtaaaccggtccgttacgggg

SEQ ID NO: 272087 - DNA, 804 bp, Homo sapiens
  misc_feature: GYAE6OF02JVS4H.13.39.D06.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (401)..(401): a, c, t, g, unknown or other
  misc_feature (401)..(401): n is a, c, g, or t
tcagtcacgtactacacgaccggtgctcgatttagtgacatctcgcagttctttgggggctacaacaggcaggcagggcagcaagatggtgttgcagacccaggtcttcatttctctgttgctctggatctctggtgcccacggggacatcgtgatcgacccagtctccagacctccctggctgtcgtctcgtggcgaagnggaccaccatacaactgctaagccagccagtcgttgttttanacgntcnccaanaataacgacttcttanccgttgaccgancgacgaaaccaggacgnccttcgaatcacgtcctattaacgttcgttacggactacgttacgttaacgacccggggtaagttccccggggtcccacgggtaacccttaagtttacccnggggtttaccgtacgggacggttccccggggtaactttccgggggggaaacttaacgggttcccttttttaacggaccgtttccgttaaccccctaacttaaccggtttccaaacggttaccgaccgttccccggttagaaccccgggtgttaccggtaacggtaaggtacgttacggttacggtttaacggttacgttttaaccgtttacggttacgttacgtaacgttaagtttaaccgtttaacgttaacgtttaaccgttacccgtttacccgtacggtacggtacccgtttaccgggtttaccggttcccggggtaaacccgggttaaccgggtaaccggttaacgggttcggtaaaaccggtaccggttaaacccggttaacgtaccggttaccggg

SEQ ID NO: 272088 - DNA, 759 bp, Homo sapiens
  misc_feature: GYAE6OF02HL9ZG.13.39.D06.1.454.CMB.1.raw
  modified_base (186)..(186): a, c, t, g, unknown or other
  misc_feature (186)..(186): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggaccagtcgtgatcggacccagtctccacgacctcccgnggtctgtcgtctcgtgggacgagcgggccaccatcaactgacaagtccagccagagttgttttaacacgtctaccaaacaaagtaacgaactttcgtaagtcctttgggaacccaggccgaaacgaaaacccgagggtaaccgacgcccctttaaccgaaggcctacgccttacttaacgtttcggtacggactagtaccttaacggtaccggggtaacgttccccggggtaacccttcggaaccttcgttaccgtagggtcggaaaccgtcggggtcgggggtacccgtaggggaacctagttatttccgaacccgttcttccgaaccctacgtccgaacgtccgaacggtcccgttgacgacgggtaccgtaaggaactgggttacgcgttaccgtaacggttttactacccgtttaggtaccgtacgtaagtaaactttacgttaaaacgttacgttaccgttaccgtaaccgggtaccggtacctttaaccggttaccgttaccggggtaccggaaaccgggttacgaacggggtaggaacgtaacgtaaccgaaaggtccgttaaggg

SEQ ID NO: 272089 - DNA, 831 bp, Homo sapiens
  misc_feature: GYAE6OF02G3J0Y.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatgacccagtctccagactccctggctgtgtctcgtgggcgagacgggccacagtcaactgacaagtccacgccagtagtttagtttaactacacgtcctccgaaaactaaagttaaagtaacctttacttacgtacttacgggaacccagtacaacggaaacccgagggaactacgcccggggttaactaagctcgacctacgttacttttaacggcggacttacgttacctaacggtaccgggaaaccggtttcccgggggttaccctacgggtaaacccgttacgttacgggtaaggttccggggtaccggtacgggggtacccggggggttttaacccggtaaggggggaaacccgtttaaacggggttaccttttttaacgggaaccccgttttacccctttaaccccgaaaacccggttaacggtttaaccccgaacggtacccggtaacgtcccgttacggaccggtaacggtaccgtaacggtaaaccggtggttacgtacggtagttacgtttaagttaaccgttcgttacgtaagtaccttaattagttaaaccgtaggttaccctcggtacgtaacgtcccttaggtaccgtttaccgggacgggtaaccggtaaccggtaagggtacgtaaggtaacctaacggtaaccgtacgttaacggg

SEQ ID NO: 272090 - DNA, 566 bp, Homo sapiens
  misc_feature: GYAE6OF02GEH85.13.39.D06.1.454.CMB.1.raw
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagtcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctaggtatcagtcagaagtcaggccagtccctgngctggacntctatcaagntgcaagcgcctcgacggactcccgtgacgcgattcctacgtcggcctaccgaactccgtacgggaactcgaacgtcccacgtacctacggaaccagtaccgaggacccgggacccaaggtacctagtacgggatacggacggtcgttagaaccttacgttaccgtgtacgacgggtaccggttaggaccgtaacggacacgtccaacgtcgcccgtatacgtcgtacgttacggacgtcggaccgtaggactacccgtataaccg

SEQ ID NO: 272091 - DNA, 703 bp, Homo sapiens
  misc_feature: GYAE6OF02JG9TA.13.39.D06.1.454.CMB.1.raw
  modified_base (243)..(243): a, c, t, g, unknown or other
  misc_feature (243)..(243): n is a, c, g, or t
  modified_base (357)..(357): a, c, t, g, unknown or other
  misc_feature (357)..(357): n is a, c, g, or t
  modified_base (509)..(509): a, c, t, g, unknown or other
  misc_feature (509)..(509): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatcgacccagtctccagactccctggctgtgtctctgggcgaggacgggccaccatcaactgacaagtccagccagtagttagtttanacagctaccaacaataagacttcttagcttacgtacaagccaagaaacccgaggaaccacgacccttaccgtaacgctacgtctactacgtttaacgtgggtctataccgttanccggggtaacgtcccgggtacccgtcggaacctagttcgaggtacgggaccgtaagggcccggggtttcggtcgggtaaaccggtcggttaactttcccgtaaccgttcccgtaaccctaaccgaccttaccgtacggaccaacggttcccncggtaacgacgggtacctaagacggtattcggtacggtacttacggttttaactaacgtttcgacgtaccgtaacgttaagttacgttaaactttaacgtaccttccgtaccgtacggtaccttacgtaccggtttccgggacgggtaaccgtacgggtaacgtgggtactacggtaacaaccggtaagtcggg

SEQ ID NO: 272092 - DNA, 659 bp, Homo sapiens
  misc_feature: GYAE6OF02HRS4P.13.39.D06.1.454.CMB.1.raw
  modified_base (256)..(256): a, c, t, g, unknown or other
  misc_feature (256)..(256): n is a, c, g, or t
  modified_base (494)..(494): a, c, t, g, unknown or other
  misc_feature (494)..(494): n is a, c, g, or t
  modified_base (523)..(523): a, c, t, g, unknown or other
  misc_feature (523)..(523): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctcgtggtgcccgacggggacatcgtgatcgacccagtcctaccgagaccttcccgtggtctgtgtctcgtggcgagacggccactatcaacgtcgacgacgtccaaggccagtggtttagtttanaccgagtccctacccaaataaagtaaaccgtaactttacgttagtcctttacgggtaaccaggaccaacggtaaaaccgacggaccaacgtcctaccgtaacgctgtacctacgtaactttaaccggcggatactacgtaccggacgggtaccggtacccggtcgtaccgactgtacgagtcggacgcggtggtccgtaggggacctggtaacttcctacgtccacgacctcacgacncctacggctggcctaggaccgtagtacgnggtacgtcggtattacgttacgttaccgngtaccganaacgtttaagttatacgacgttacctacggtccgtacgtcgtactccggttgggaccgggtaacggagtaacgggtaaaccgtagaacgtacgagtcgg

SEQ ID NO: 272093 - DNA, 606 bp, Homo sapiens
  misc_feature: GYAE6OF02GUZNC.13.39.D06.1.454.CMB.1.raw
tcagtcacgtactacacgaccggtgctcgatttagtgacatctcgcagttctttgggggctgggcctcaggaagcagcatcggaggtgcctcagccatggcatggatccctctcttcctcggcgtccttgcttactgcacaggatccgtggcctctatgagctgactcagcccacctcagtcgtccgtgtccccaggacagacagccagcatccactgctctaggaaataagtgcagaataaatatacttctggtatcgagcagaagtacaggccacgtcccctgtcgctggtacagtactactacaagtatcgaccgacgccgcctacgacggtactccgtgagtcgattcgtcgtacgcctacctaacgtcggtacggtaactcgaccgtcaccttcgacaccgtagccacgggacccggacccgacggtacttaggcgacgtgaccgtacacgttactacgtttataccgttacggacggtaccggttggaaccgtagaccgagcccgtacgtaccggccgttaagttccgtacgggtttaccgtaccggtaacggtaccggtaaccgtaacggttaccccgtaccggttaacggtaacccgg

SEQ ID NO: 272094 - DNA, 712 bp, Homo sapiens
  misc_feature: GYAE6OF02F2DQM.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatgacccagtctccagacctccctggctgtgtctcgtgggcgagacgggccaccatcaactgacagtccacgccagagttgtttatacagctaccaacaataagaacttcttagtcttaggtaccagcaagaaaccaggacacgcctacctaagctgcctactatttacgtcgggcatactagtaccgggtaacgttcccggggtaccctcggaacctacgttccgaggttcggacgtacgggtccggggttcgtaggggacctaggttaactttaccgaccttacctacctaacctacgttacccaagaccgtaccgtaccgtcggaccggtaacggtacgtaggtaaacggtacggttggttacgggtaacgtttaaggttttaacttacgtttacgtacgtaacgtaacgttaaatttaacgttaagttaaccgttacccttcccggttaccgtacggtaccgtttaccgtaccggtttaccgggaccgggtaacggtaaccggtaagggttacgggaacgttaacgtaaccggtaaaccggtagttaccggg

SEQ ID NO: 272095 - DNA, 676 bp, Homo sapiens
  misc_feature: GYAE6OF02J1UI7.13.39.D06.1.454.CMB.1.raw
  modified_base (243)..(243): a, c, t, g, unknown or other
  misc_feature (243)..(243): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatgacccagtctccagacctccctggctgtgtctcgtggcgagagggccaccatcaactgcaacgtcacgccagagttagttttanacagcctaccaaataataacgaacttctagcttggtaccagcaagtaaacccaggacacgtccctacctaagcgttcgacctactaatttcgtacgggctatctacgtaccgggtaacgtcccgggtcctagactacttcgagtcggcgtagggacgggttcgtacgggaactacgttactttaccgaccgtctaccgtacctacgtaccacgaccgacggtaccctaggacgtacgggtacgtacgtaaacggtacgtgggttacggtacccgtttaagtttaaccgtttaacttcggtaactaaccggtacttaaacttacgttaacgttaccttaccgttccccgacgtaccggtccgttacccgtccggttacgggaacccgggtaggtaccggtaaggtacgagtaacctcggaaccgtacgttacgg

SEQ ID NO: 272096 - DNA, 752 bp, Homo sapiens
  misc_feature: GYAE6OF02GTF6H.13.39.D06.1.454.CMB.1.raw
tcagtcacgtactacacgaccggtgctcgatttagtgacatctcgcagttctttggggctgggcctcaggaagcagcatcggaggtgcctcagccatggcatggatccctctcttcctcggcgtcttgcttactgcacaggatccgtggcctcctatgagctgactcagccaccctcagtcgtccgtcgtccccaggacagacagccagcatccacctgctacgtagaaattaaagttggacaagaataaatactacttccgtaggtactcagcaagagtcacggcctacgtcccgtgtcgcgtcggtacattcctagtacgaacgtctaccgaccgaacgtcccggtaccctacggaacgggtccctacccgtaggacgtccgtaactttccgtccgtacggtaccctccgtaaccgtcgggtacggtaacctcgaccgtcctacgtcctaccgaacctagtacccgggacggtacccgggaacccggtacgtacgttaacggtacgggacgtacgggtaccggtacgttacgttaaaccgttaaccgtttacggtccggtaaccggggtacgggttaccggggtaccggtaaaccggtaacggaccgtaacggtcccgtaacctaccccgggtaacccggttaacctttacggtaacccgggttttccccggtaaaccgggttaacccgggtaccggggtaaaaccccgttaccggttaacccgtaaccccggtttaccggaaacccggg

SEQ ID NO: 272097 - DNA, 847 bp, Homo sapiens
  misc_feature: GYAE6OF02J046F.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatcgacccagtcctccagactccctggctagtgtctcgtgggacgaggacggggtcccaaccataccaacgtcgtacgaacgttccaaggcccctaaggtaggttacgtttttaacaaccgacggtaccttacccaaactaaaagttaaacgtaaccgtttactttaacgacgtttacgggtaacccaacggtacaaacggtaaaacccgaacgggtaccaacgtaccctaacccggtaaaagtcccgtacggacctttacctaaacgtttttaccgacggggtaacctacgttaaccgtacggttaacccggggtaaaccgttcccggggggtaccccttaggggtaacccttacgtttccgaaggttccgggacgtacggggtccgggttaccggtacgggaaccgtaagttagtttaccctacgttccgtaccaccgttacgtacgaacggtccgaacgtccgtacgtacggccggttacgtacgaacgttaagtcggtacggagtttacggtttaccttacttacgggtaactacggtaacttaaagtttaacttacgtaaccgtaccgttaacccgtaccgggtagttccctaaccggttaaccgtttagggggaacccggttaaccggggtaaccgacgggttacggtaaccgtaaacggtaccggtaaaccgtaacggttccggg

SEQ ID NO: 272098 - DNA, 636 bp, Homo sapiens
  misc_feature: GYAE6OF02G9NGU.13.39.D06.1.454.CMB.1.raw
  modified_base (240)..(240): a, c, t, g, unknown or other
  misc_feature (240)..(240): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgacaagtccagccagtagttgttttanacagtcctaccaaacaaataaacgtaactttcgttaagtctttaggtaacccagacaaacgaaaacccgtaaggaacacggtccctactaacggcctcgaccttactatttacgtgggactagttctaacggtccgggtaacgtcccgggtaccctaggtacccgatttaccgaggttcggaccgtacgggtcgggtcgtagggacctagtactttccacgtcctacaccactacagaccacgcctgcgaggtctagaacgtgtacgttacgctttaagtttatacgtagtactagaacttaattattacgtactaccctaccgtcggactcgttacttacggtcggtacggaccggtaacgtagggtcgtaaaggtactaaccgaagtccgtaag

SEQ ID NO: 272099 - DNA, 739 bp, Homo sapiens
  misc_feature: GYAE6OF02F39HV.13.39.D06.1.454.CMB.1.raw
  modified_base (368)..(368): a, c, t, g, unknown or other
  misc_feature (368)..(368): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctcagacctccctggctgtgtctcgtgggcaggacggccaccatcaactgcaagtccagccagtacgttgttttaactacacgtcctacccaaacaaactaaacgtaacctttcgttaacgtccgtttacggttaacccagtaccgaaacgaaaacccgaggtaaccacgtccctaccgtaacgctcggctactagtttacgngggactactcgtacgtaccgggtaacggtcccggggtaccctacggtaacccgtagttacgagggttcggaccgacgggtaccgggggttcgtacggggaactaggttacctttacgaccttacgtacccaacctacgttccaacgggactacggtacctcggacgtacgggtacctaagggaaacgtaggttcggtggtaaccgtttaagtttacgtttactcggtaaccgtaacggtacttaaaagtttaacgtttaaacgtaccgttaccgttcccgtaccggttacgccctttaacggtaccggtttaccgggacggtaacgggtacgtaacgggtacggaacgtacggaacgtaccggtagtcggg

SEQ ID NO: 272100 - DNA, 799 bp, Homo sapiens
  misc_feature: GYAE6OF02IU34G.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatcgacccagtctccagactccctggctgtgtctcgtgggcgaggacgggccaccactacaactcgaccaagtcccacgccagtacggttagttttacacacgacctaccaaactaaaactaaacgtaacctttacttacggtccgtttacgggtaacccaggaccgtaaacggaaaacccgtaacgggaaccgaccggtacccttacccgtaaaggcccgtcgtaccttacctaattttaccggtacggggtctacgttaccgtaaccggttacccggggtaaccggttcccggggttaccctacgggtaaccgtactttacgtacgggtcggaccggacgggtcggggtacgtacgggactacgttactttccgtacctacctaccaaccgactacgtaccgaccgacgtcccgtacgtcggacggtaccgtaggtaacggtacgttacggtacggtacgtttaagttttaacgttaccgttagtaccgtaagttaacgttaactttaactttacgttaacgttacccttacccggttccgtacggtacccttaccggttacgggtttacccggggacgggtaacgggtaacccggtaagggtcgggtaaagttaacggtaactaaccggtacgttacggg

SEQ ID NO: 272101 - DNA, 844 bp, Homo sapiens
  misc_feature: GYAE6OF02H757E.13.39.D06.1.454.CMB.1.raw
  modified_base (252)..(252): a, c, t, g, unknown or other
  misc_feature (252)..(252): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgaggggacatccgtgatgacccagtctccagactccctgactgtcgtctcgtgggcgaggacggccacagtacaactcgactacgtccagccgaaggtagttagttttanaacgacgtacctaccaaacgtaaactaaacggtaaaccttacgtttaacgtccgtttacggttaaacccgacggaactaaacgaaaacccggtaacggaacccgtaaccgtaccccttaaccgttaacggcgttaccgtacccgttacgttaacggtttttccgtacggggtaaccttaacgttaccggttaaccgggtaacccggggtaaccggggttaccccggggtttccccgtacggtaacccggtttaagttaccggtaagggtccgggtaccgtacccgggggttacggttacgggttaccgggtaccgtaagtttaccggtttcctaccggttacctaacccggtaacctacgtacgtaccgtacgacgtaccgtgtaccggtaccgtaccgtaaaggtacgtaacgtcgggtacgtacggttaacgttttacgttacgttcgtaaccgtagtacgttaaattacgtaaacgtactttaccgtaccgtacgtaccgttaccgtcgttaccggtttacggggccgggttaacggacccgggttaggtacggtaacgtaaccggtaacgttaacggtcgttaacggg

SEQ ID NO: 272102 - DNA, 598 bp, Homo sapiens
  misc_feature: GYAE6OF02HRB73.13.39.D06.1.454.CMB.1.raw
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccacatcaactgacagtccagccagagttgttttanacagctaccaaacaataagaacttcttagcttggtaccagcaagaaaccaggacacgcctacctaagcttgcctcatttacgnggcatctagtccggaagtccgggtcctgaccgtattcgagtggcaggtcgggtcgtagggactaggtatttccgacttcctaccaacctatccagccacgtcctgcgaggctagaagtctgtggtacttagtttaacttacgtagtctagacttaaagttattacgtaacgttacccttcccgtacggtacggtcctaccgttaccggtttacgggaccgggtaacgggaccgtaacgggttacggaacgtacgtaaccgaacggtacgttacggg

SEQ ID NO: 272103 - DNA, 727 bp, Homo sapiens
  misc_feature: GYAE6OF02GAI71.13.39.D06.1.454.CMB.1.raw
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccgatcgaactgacaagtccagccagtagttgtttanacagtctaccaaacaataagtaacttnttaagtcttaggtacagacaacgaaaccgagacagacctacgtaagctgtctactacttacgtggactacgttcgtaagtaccgggtaacgttcccggggtcctacggtaaccgtacgttaccgtagggtcggtacgtaacgggtccggggttacgacggggaactagggttaactttccgaaccgttcccgtaccgtaaccccgtaattccgtaacgtaccgaccgtaccgtacggtaccgtaacggtaccgtaggaacggtacgttacggttaggaccttaaggttttaactacctaggttaccgaagtactaaagtttaacttacgttaacgtaccctacggtaccgtacgtacccgtttaacggtaccgggttttacggaaccgggtaaccgggtaaccgttaaggggaccggtaaaccgggtaaccgtaaacggttaccggtggtaaccggg

SEQ ID NO: 272104 - DNA, 890 bp, Homo sapiens
  misc_feature: GYAE6OF02F2UP3.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacgggacatcgtgatgacccagtctccagactccctggctgtgtctctgggcgagacgggccaccatcaactgacagtccagccagagttgtttatacagctaccaacaaataagaacttcttagcgttaggtaccagcaagaaaccaggaccagccctactaacgctgctctaatttacgtgggacacttacgtacgtaccgggaacgttccccggggtaccctagtacccgtagttccgtaaggtcggcacgggtccgggttacgtacggggaactacggttaacgttttcctaacccgttcctaccctaaacccccgtagtttaccccgaaggaccccgtaccggtaccccgttcggggaacccgtaacggggtacccgtaacgggtaaaacgggttacgtttacgggggttacggtaacccgttttaaacggtttttttaaaccgttaacccggttttacggttaacccggtaaaccggtttaacccggtaaaaattttttaaagtttaaaccggtttaaacccgtttaaccccgtttaaccccccgggtttaccgggtaaacccgggttaccccgtttaacccgggtttaaaccccgggtttttacccgggggggaaaaccccgggggttaacccgggggttaaaaccccggggttaaacgggggttttaaccggggggtaaacggttaaaccccggttaaacccccgggttaaaaaccgggttaacccccggtttaacggggg

SEQ ID NO: 272105 - DNA, 867 bp, Homo sapiens
  misc_feature: GYAE6OF02FRYGF.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcattttctctgttgctctggatctctggtgcccacggggacatcgtgatcgacccagtctccagactccctggctgtgtctcgtgggcgaggacgggccaccatccgaactgacaacgtccacgaccaagtacgttagttttactaccacgaccttaccaaacaaacgttaaagtaaaccgttttccttaagtaccgtttacgggtaacccctaaggacccgaaacggtaaaaaccccgtaagggaacccaacggtacccctttaaccctaaaacggtcctcggtccttactaacgttttaccgtaggggtacctaacttccgttaacgtccgggggtaaaccgtcccgggggttccccttacggacccggtacgtttcgaacgggtttcgggaccgacgggtccggggttacgtcggggtaactaacggtactttaccgaaccgtttcctaccgtaaccctaacgttaccgaacggtcctaccggtcccgttacggaccggtacggtaccgtagggaaacgggttaacgttcggtacgggtaccgtttaacggtttttaccgtttaacgttccggttaaccgtaacgttaaccgtaaagttttaacgtttaaattaaccgtttacccttccccggttacgtaccggtacctttccggtaaccgggtttttccgggaaccgggggtaaccggtaacccggtacggggttacgggttaaccgtaacggtaacccggtaaaacgtaccgggtttacgggg

SEQ ID NO: 272106 - DNA, 709 bp, Homo sapiens
  misc_feature: GYAE6OF02IBAQN.13.39.D06.1.454.CMB.1.raw
  modified_base (159)..(159): a, c, t, g, unknown or other
  misc_feature (159)..(159): n is a, c, g, or t
  modified_base (186)..(186): a, c, t, g, unknown or other
  misc_feature (186)..(186): n is a, c, g, or t
  modified_base (362)..(362): a, c, t, g, unknown or other
  misc_feature (362)..(362): n is a, c, g, or t
tcagtcacgtactacacgaccggtgctcgatttagtgacatctcgcagttctttggggctgggcctcaggaagcagcatcggaggtgcctcagccatggcagtggactccctctcttccgcggctcttgcttactgcacaggctcgtcggccctctagngagtctacgactcacgccctaccctgngttcgtccgtcgacccgaggacacgacacgccatcacgtccactgtacgtacgtaaaggtaaaattaacgttcggaataagtaattaaaactacttaccttaccgtaggtactacgagaagaagtaacgtcaccgaccgtccgtcccgtgtcgtacgtgtactacttactacgtanaagtacgacgacgaccgccgtaccgacggacgtaaccgtccggtacgacgtacgttacttcgtaccgttacggtaccctacgttaaccggtcgtaacggtacctaccgaaccttacctacctaccgtaccaccgtactcgggaccggacccggtaacgcgtactaacgtaggacgtacgacggtaccgttacgtaacgtttacgtacgtcgggtacgtacgggtcgggttaacggaacgaacggtcaccggtactacccggtccggtaccgtatttaccgggctttaccgggtaccgtaacccgggtacggaccggttaacctcccgtaccggttaactaacccggg

SEQ ID NO: 272107 - DNA, 680 bp, Homo sapiens
  misc_feature: GYAE6OF02G20MO.13.39.D06.1.454.CMB.1.raw
  modified_base (126)..(126): a, c, t, g, unknown or other
  misc_feature (126)..(126): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
tcagtcacgtactacacgaccggtgctcgatttagtgacatctcgcagttctttgggagctacaacaggcaggcaggggcagcaagatggtgttgcagacccaggttcttcatttctctgttgctntggatctctggtgcccgacggggacatcgtgatcgaccctagtcctccagacctcccgtggctgtgtctcgtgggcgagcggccaccatccaactgacaacgtccagccagtagttgttttanacncgctacaaactaataagactttctagtcgttacgaccagacgaacgaaaccgagacgacgccctactagctnctntattcgaggctatcgtagtccggaacgttcccgggtacctaggaccgtatcgagtcgcgacgggtcgggtgagggaacctaggttcttacgccgttctcaacctactcgacgacgtacgccgtcgacgtcggacgtaaggacgttacggtggacggtacgttttaaagtttacgtacgtagttaacgtactaagttaaacttaagtttaaccgttaccgtaaccccttacccggttaccggtaccgttcccgttaccggttacccgggtttaaccggggacccggtttaacgggaaccgggtttaaggggtaaccggtaaccgggtaaacgtttacccgggtaaaacggtcgg

SEQ ID NO: 272108 - DNA, 853 bp, Homo sapiens
  misc_feature: GYAE6OF02HUT9D.13.39.D06.1.454.CMB.1.raw
tcagtcacgtactacacgaccggtgctcgatttagtgacatctcgcagttctttgggggggggtctcaggaggcagcactctcgggacgtctccaccatggcctgggctctgctcctcctcagcctcctcactcagggcacaggactccgtgggctcagtctcgcctgactcacgtcctcgtctctacggtcggtccgggttcctccgtacgggactacgtcgacgtaccaacctactcccttccgtcgaccgtacgttacggaacctaggtacgtacggtcgtaagttggtttacgggttaggttaactaacgttacgttcggttacctaccgttacggtaaccctaaaccgtaaaccgaaccggtaaccggtaaccgaaaacccgtaaacccccgtaaaacgttaccgtaacgttaggttaacttttaacgtacgttacgttacgtaaccgtaagggtaccggtacccgggtacccgttaaccgggtaccggggttaccctacgggtaccgttccgttaccttccgttccgtaccgtcccgttacgtaaccgttccgacggtacccgtaaaccggtcccgttacccgtaccgtacgtaaacctccgttccggttccgtaccgggttccctacggacggttacgtaacggtacggtgttccggaacgttccggttaagttacttttaacgtcggttgttaccttcgtacttacgtaagttcgtcggtaacgaccgtacgaccgttacctaaccggttacgttaccggtttaacggtacgggtaccggtaacggggtaaccgacccggttaacggtaccggttacccggtacccggttacgtaccgggtaccg

SEQ ID NO: 272109 - DNA, 711 bp, Homo sapiens
  misc_feature: GYAE6OF02I9ON7.13.39.D06.1.454.CMB.1.raw
  modified_base (155)..(155): a, c, t, g, unknown or other
  misc_feature (155)..(155): n is a, c, g, or t
  modified_base (344)..(344): a, c, t, g, unknown or other
  misc_feature (344)..(344): n is a, c, g, or t
tcagtcacgtactaacacgaccggtgctcgatttagtgacatctcgcagttctttgggggctacaacaggcaggcaggggcagcaagatggtgttgcagacccaggtcttcatttctctgttgctctggatctctggtgcccacggggacatcgngatgacccagtctccagacctccctggctggtcgtctcgtgggcgaggacggccaccagtcaactgacaagtccagccagtagttgttttacaccggctaccaaaccaataacgtactttactacgtctttaggtaccagcaagaaccgaggacacgcctacctaagctagtcctactacttttaccgngggactagttccttaacgtcccggggtaacgtcccggggttcccgtagacccgaatttaccggaaggtcgggtaccagggtcgggtaccgtcggggaactacggtttactttacgtaccttccgtacaccccgtaagtacccacggtacctacgtcccgttacgacccggaggttccgtaaggacgtaggttggttacggtacgtttaagttttaacgttcggttacttctaacgtataactttagtttaacgtacgttaccgtaccgttaccggtacgtacgttcgtacggtttaccgggtacgggtaacggtaccgtaacgggtaggtaacgaaccgttaagaaacccggttgttacggtaccgg

SEQ ID NO: 272110 - DNA, 566 bp, Homo sapiens
  misc_feature: GYAE6OF02FUTY8.13.39.D06.1.454.CMB.1.raw
  modified_base (237)..(237): a, c, t, g, unknown or other
  misc_feature (237)..(237): n is a, c, g, or t
  modified_base (421)..(421): a, c, t, g, unknown or other
  misc_feature (421)..(421): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagtcttggtaccagcaagaaaccaggacagcctctaaggctgctcattactgggcatctagtccggaagtcccgggtaccctgaccgtattcgagtcggcaggtccgggttcgtagggactagtaactttcacttctcaccatcagcacgcctgaccgngactaggaagagtgtcgtgttagtttattactgtacacgacttaatattagtagtacctccgtaccgacgtcctaccttcgttaccgggtaccggtacgggtaccggaagggttcggaagtacgtaaccgtaacgtagttacggg

SEQ ID NO: 272111 - DNA, 802 bp, Homo sapiens
  misc_feature: GYAE6OF02HT4CP.13.39.D06.1.454.CMB.1.raw
  modified_base (266)..(266): a, c, t, g, unknown or other
  misc_feature (266)..(266): n is a, c, g, or t
  modified_base (480)..(480): a, c, t, g, unknown or other
  misc_feature (480)..(480): n is a, c, g, or t
  modified_base (776)..(776): a, c, t, g, unknown or other
  misc_feature (776)..(776): n is a, c, g, or t
tcagtcacgtactacacgaccggtgctcgatttagtgacatctcgcagttctttgggggctacaacaggcaggctggggcagcaagatggtgttgcagacccaggtcttcatttctctgttgctctggatctcgtggtcgcccgacggggacattcggtgatcgacccagttcctccacgtacctcccgtggcttgtcgtctcgtgggcggaggtcgggcccacatacaacgtcgacacgtaccgagccaggttagtttgttttanaccaagtcctaacccgaaaataaagttaaacgtaaccttttacttaagtccggttttaacgggacccaaggtaccgaaaacggtaaaaccctagggaaccctaccgtccttaaccgtaacgccgtgtccttaacgtttaagtttaccgggacggttacgtacttaaccgtacggtaccgggtaaccggtttcccgggttcctacggtaaccgtnttacggacggtcggacgtacggggttcgggtccggttaacgggaccgttaacggtttccctttaccgtaccgttaccctaaccctaaccgtagtaaccctgggaaccttccgccggtaacggtcgaacgggtacgttaagtagttacgttaacgtacttaaccgtttataccggttactacgtaacctaacgttacgtttaacccgttaaccggtttcccaagtttccgggtacggtttccgggggaagggaccgggtaacgtaacgggtacggtagaacgtaccgtaacggtcgnggtaccgtcgtacgtcccttaaccgg

SEQ ID NO: 272112 - DNA, 710 bp, Homo sapiens
  misc_feature: GYAE6OF02G9F06.13.39.D06.1.454.CMB.1.raw
  modified_base (124)..(124): a, c, t, g, unknown or other
  misc_feature (124)..(124): n is a, c, g, or t
  modified_base (154)..(154): a, c, t, g, unknown or other
  misc_feature (154)..(154): n is a, c, g, or t
  modified_base (360)..(360): a, c, t, g, unknown or other
  misc_feature (360)..(360): n is a, c, g, or t
  modified_base (524)..(524): a, c, t, g, unknown or other
  misc_feature (524)..(524): n is a, c, g, or t
  modified_base (572)..(572): a, c, t, g, unknown or other
  misc_feature (572)..(572): n is a, c, g, or t
  modified_base (641)..(641): a, c, t, g, unknown or other
  misc_feature (641)..(641): n is a, c, g, or t
  modified_base (702)..(702): a, c, t, g, unknown or other
  misc_feature (702)..(702): n is a, c, g, or t
tcagtcacgtactacacgaccggtgctcgatttagtgacatctcgcagttctttggggctacaacaggcaggcaggggcagcaagatggtgttgcagacccaggtcttcatttctctgttgctntggatctctggtcgcccacggggacatcgngatgaccccagtctccagacctccctgctgtgtctcgtggcgaggcggccaccatcaacgtcgcctaagtccacgcctagtacgttgttttagacctagcctaccaaacgaaataaacgtaacctttaccgttaagtaccgttacggtaaccgacgaccgtaacgaaaacccgaacgggactaccgaccctacccggtaaggtacnggttacctactttaacgttttaccggttcggacttaacgttacctaacggtaccccgggtaccggttcccccgggtacccgttcgaaccgttagttcacggtcggacgcggtacgggtcgtaacggggactacgttacgtttaccacgttccctaacctaaccngttaaccgcgaccgtccgccgttcggcgaacggttcgaaacgttaggngttcgtcgtagttacttttagtcgtatacgatacgttaaattcttaaagtccgttacctctaccggtanacttcggtaccgttcggggtcgaacgggttacctagggcgtaacgtaacgtaacccggtanaccggttg

SEQ ID NO: 272113 - DNA, 769 bp, Homo sapiens
  misc_feature: GYAE6OF02FNA0L.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgacaacgtccacgccagagttgttttatacgagacctaccaaactaaataaacgtaaccttacttaagtctttacggtaaccacgacaacgaaaccgaggacacgacctacctaacgctcgctctagtttacgcggactattccgtacgtacccgggtacgttcccgggtacctacggtacgtactttacgacggtacggcggtacgggtccggggttacgtacggggtaccgtaacgtttacgtttaccaccgtttacccgtaccctaaaccgtacgttaccgaaccggtaccgtaccgttacccgtcggaccggtagggttaccgtaacgaaggtaccgttagggacgttaccggtttaagttttacgttaccgttagtacgtaacgtacttaaacgttaactttaaaccgttaacggttacccttaccgtacccgggttaacgttcccgttaaaccggttaccggttaaccgggggtaccgggttaaccggaaaccgggttacgggtaggaaacccgttaacggaaacggttaaaccgtacgggttacggg

SEQ ID NO: 272114 - DNA, 650 bp, Homo sapiens
  misc_feature: GYAE6OF02I3SN6.13.39.D06.1.454.CMB.1.raw
  modified_base (242)..(242): a, c, t, g, unknown or other
  misc_feature (242)..(242): n is a, c, g, or t
  modified_base (502)..(502): a, c, t, g, unknown or other
  misc_feature (502)..(502): n is a, c, g, or t
  modified_base (573)..(573): a, c, t, g, unknown or other
  misc_feature (573)..(573): n is a, c, g, or t
tcagtcacgtactacacgaccggtgctcgatttagtgacatctcgcagttctttgggggctacaacaggcaggcaggggcagcaagatggtgttgcagacccaggtcttcattttctctgttgctctggatctctggtgcccacggggacatcgtgatgacccagtctccagactccctgctgtgtcgtctgggcgagagggccacatcaactgacaagtccagccagagtgtttactacgngtcctacaacgtaaattaagaaaccttcttaacgtcgttaggtaccaagtcaacggtaaaccaggacacgacccttaccgtaaagcctacgctactaagttttacgagggctatcgtaacggttccgggaacgttcccgggtacctcgtaccgtacttcgagttgacctagggtcggtactcggggaataagtactttccacctacgtactaccagttaccgagtcctaacgtccttacgcgtaacggctagaaacggtntacggttacgacgttaatttacgttacgtacgacgtacgacgttaattaacgtattaacgtaccgttaccncgtaacgtccgtcgtaaccggtttcgggacggtaacggaccgttaaggtcggaacctagtaaccgaagtcgttacgg

SEQ ID NO: 272115 - DNA, 934 bp, Homo sapiens
  misc_feature: GYAE6OF02HU4QK.13.39.D06.1.454.CMB.1.raw
tcagtcacgtactacacgaccggtgctcgatttagtgacatctcgcagttctttgggggctacaacagacaggcaggggcagcaagatggtgttgcagacccaggtcttcatttctctgttgctctggatcctctgggtcgtcccgaacggggactacgttcggttagatcgacccctaggttctccgagtaccttcccggtggtcgttggttcgtccgtacggtcggggcggtaacgggacgggtcccacccgtattaccgaacgttcgaaccgtaaccggtaccgcgtaaccgaggtaacgttttggttttaactaccgtaacgtaccttaacccaaaaacgtaaacgttaaaacgttaaccgttttaccgtttaaggtaccggttttaaccggtaaccccggaacggtcccgaaaaacggtaaaaccccggaacgggtaacccgtaccggtacccccgtttaaccgtaaacggtccttccggtaaccgtttccgttaaacgtttttacgggacgggttaacctctttaaccggttaaccgggttacccgggaaaccggtttcccggggtacctacggtaccgttacgttcgaggtcggtacggacggtccggttacgacggttaccgtaacggttaccgttaactcccgttaaccgtacccgtaaacccttacggtaccgtaaacggtcctaccggacccgttggaacccggttaggtaacccgttaaggtaaaccggtacggtttacgggtaccgtacgttttaagtttaacgttaccgtacgtacgtaacgtaagtaactttacgttacttaaccgttcgtaccttacggtaccgtcgttaccggtccgggttaaccggtccggggaaccgggttaccggttaaacggggttcggaacttaaccggaacggttacggtacggtaccggg

SEQ ID NO: 272116 - DNA, 755 bp, Homo sapiens
  misc_feature: GYAE6OF02I4FDH.13.39.D06.1.454.CMB.1.raw
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
  modified_base (249)..(249): a, c, t, g, unknown or other
  misc_feature (249)..(249): n is a, c, g, or t
  modified_base (476)..(476): a, c, t, g, unknown or other
  misc_feature (476)..(476): n is a, c, g, or t
  modified_base (499)..(499): a, c, t, g, unknown or other
  misc_feature (499)..(499): n is a, c, g, or t
  modified_base (521)..(521): a, c, t, g, unknown or other
  misc_feature (521)..(521): n is a, c, g, or t
tcagtcacgtactacacgaccggtgctcgatttagtgacatctcgcaggttctttgggggctacaacaggcaggcagggcagcaagatggtgttgcagacccaggtcttcagtttctctgttgctctggatctntggtncccgacggggacagtcgtgatcgtacccgatctaccaagacctccgtggctgtgtacctgtggcgagacgggccacgatcgaactgcaagtccagccagagttagtttanacgtgaccgtaccaactaaagttaacgacgttcttacggactttaggaaccccagaccgaacgaaaacccgtaacgggaacacggtccttaccgaaacggtccttaacggcctacgttagttaccgtacgggtataaccgttaccgtacgtaacggggtaaccgttacccggggtacccttacgaacccgtacgttaccgaaggttacgtacgacggggtaccggtntacggggacctagggtaccttanaccgtactacgaaccacgtacncgtaacacgtaccgtacgaccgtacggacgtaacgaaacgtggagttaccggagtttaacgttaagttaccgtaatacgtaaacgtaacgttaaacgtttacgtaacggttaccgtaaccgttacccgtacggttacgtaaccggtaacgttttaccgggaacgggtaaaccgtaacgggtaggtaacggttaagtaaccggtaacccgaaacgggttaactaccggtaaccgg

SEQ ID NO: 272117 - DNA, 745 bp, Homo sapiens
  misc_feature: GYAE6OF02HKBGO.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgagacgggccaccatcactgacagtccagccgagtagttgtttacacgacgcctaaccaaactaaagtaaacgtaacctttacttacgcgtttacggtaccaaggacctaaacggaaacctagggaccacggtccccttaccgtaaagccgtcgtccgtaccttagtttaaccggtgggactacgttccgtaaccggtaccggggtacggttcccccggggtaccctacgggtaaccgttattcccggtaggtacggacgtacggggtcccggggtacgtacggggtaacctaacgggtttacgtttaccctaacccgttaccctaccgtaacccgtaacgtccgaaacgtccgtaaccggtcctaccggtaccggaggttaccgtaggtaacgtaagttcgtacgtacctttagtttacgtacttacgtcgaacgtacttaacgtttatacgtacgttactcccgtacgtacgtaccgttcgtaccggttcgggaacgggtacggaacggtcgggacgtaacgtactaacggtacgtagtcggg

SEQ ID NO: 272118 - DNA, 726 bp, Homo sapiens
  misc_feature: GYAE6OF02JXNHI.13.39.D06.1.454.CMB.1.raw
  modified_base (165)..(165): a, c, t, g, unknown or other
  misc_feature (165)..(165): n is a, c, g, or t
  modified_base (247)..(247): a, c, t, g, unknown or other
  misc_feature (247)..(247): n is a, c, g, or t
  modified_base (406)..(406): a, c, t, g, unknown or other
  misc_feature (406)..(406): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccacggggacatcgtgatcgacccntctccagactccctggctgtgtctcgtgggcgaggacgggccaccatacactcgacaacgtccagccagtagttacgtttanacacgtcctaccaacaactaagtaccttcgttagtcgttcggtacagacaacgaaccgacggacaccgtcctaccgtaagctacgtctactacgttacggtcggactacgttaccgtaacgtaccggggtaccgtacccgggtcccgtacgaaccgttnttacggaacggtcggtaccgtacggggtccgggtacgttaggggacctaggttacctttacgacctccgtactaccgctacgacgacgtacgcgtacgacgtacggtcctaggaacgtcggttaaggtcggtacgttacgtttacgttacgtacggtacgtaacgtacttaacgtttaagtacgttaaccgttccgtaccggttacccgacgtttaccggtaacggttaccggtttaccggggaaccggggtaacggtaaaccgggtaggtaaccggggttaacgtaaccggtaaacccggttaaggacccggttaaggg

SEQ ID NO: 272119 - DNA, 661 bp, Homo sapiens
  misc_feature: GYAE6OF02GYSVL.13.39.D06.1.454.CMB.1.raw
tcagtcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttgtgttatactatgtctctgtaccaacaacaccagaccaaacgccccaaatcatcgtattatagtatgtactaagtacgcgcctacgtacgggtcctgactcgtcttctctcgtcctacgtacgtcgtacggactaaccgacccggtccctcccgtacgtacctacgttccgtccgttcgggaccttacccggaggtacctacggagggtacttcgggtacgttctaggttaactttaccgttaacgtcgtacctttgaccttacgtaattacgtccggtacgaacgggtacccgagtaccccgttaacgtacgtttaaccggttaaccgtttaccgggtacccggggaacggggtaacccgggtaacccgtaaggtcccggtacccggttaacccggtttacccggttaccggtaacccgg

SEQ ID NO: 272120 - DNA, 865 bp, Homo sapiens
  misc_feature: GYAE6OF02F9TWZ.13.39.D06.1.454.CMB.1.raw
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctcgtggatctctggtcgcccgacgggactatcgtgactcgacccagtctccagactcctggtctgtntctcgtgggcgagacggccacgatcaactcgacaacgtcacgcaggtagttactttanacncgtacctaaccaaactaaactaacgtaaccttacgttaagtaccgttacgtaaccgacgacgaaacgaaacccgaacggaacctacggtacccgttaaccgtaacggtaccgtacgtaccgttacttaacgttttacggacgggtaacctaacgttaccgttaaccggtaccgggtaaccggttccccggggttacctaaccggtaaccggttacgttacgtacggtacgggtccgtaacgggttcggggttaccgtagggtaacgtaccggtaacttaccgtaacttacctaaaccgtaccgtaacgtacgtaacggtaccgtaaacggtaaccggtaccggtaaaccgtaacggttaaacgttaccgtttacgttaacctttaacgttttacgttttacccgtacgttaaccgttaacggtaaccgtttacggttaaccggttaacggtaacccgtttaaccggttaaacgtttacccgggtttacggtacccgggtaaaccgggttacgtaacgggttaaccgggaacggttaacgggtaaccgttaaacggttaacggtaaccgtaacgggttacggttacccggtaccggttaccggtactaaacccgg

SEQ ID NO: 272121 - DNA, 980 bp, Homo sapiens
  misc_feature: GYAE6OF02I18GS.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagacctcccgtggctgtgtcctcgtgggcgagacgggccacactcaactgaccaagtccacgccaggtagttgttttaacacacgccttacccgaaactaaattaaacgaaacttttccgttaagtcgtttaggtaaccccaggtaccaaggaaaaacccgtaggaacctaacggcccttaccgttaaaggccttacgaccttacctaagttttaccgtcggggactaacgttccgtaacggtacccggggtaaaccgttccccgggggttaccccttacggaacccgttaacgttaccgaacgggttcggaccgtaaggggtcccggggtttacggtacgggggtaaccttaacggtttaaccgttttacccgaacccgttttacccgtacccgtaaaccccgtaacgtttacccgaaccgggttaccgtaaccggttaccccggttacccgggaccgggaaacccgggtttaccgttaaacggggaaaacggtttacgggtttacggggttacgggttaaccggttttaaaccgggttttttaacgtttaacccggttttaccggtaacccggttaaggtaacccggttaaaatttttaaaccgttttaaacggtttaaacccggtttaacccgttaccccgggtttacccggtaaccgggtttacccgtttaacccggttttaacccggggttttacccgggggaaccggggggttaaacccggggtaaaccggttaacggggggttaccggttaaaccggtaacccgggtttaaaccgtaaaacccgggttacccggtttaacgggg

SEQ ID NO: 272122 - DNA, 933 bp, Homo sapiens
  misc_feature: GYAE6OF02HTDF4.13.39.D06.1.454.CMB.1.raw
tcagtcacgtactacacgaccggtgctcgatttagtgacatctcgcagttctttgggggctacaacaggcaggcaggggcagcaagatggtgttgcagacccaggtcttcatttctctgttgctctgatctctggtgcccgacggggacatcgtgatcgacccagtcctccagacctcccgtggctgtgtctccgtgggacgaggacgggccaacctatacaacgtcgacgtaacgtaccagtaccgaaggtacgtttagttttaactacgtacgcctaccaaaactaaacgtaaaacgtaacctttacgttaacgtcgtttacggtaacccgaacggtacgaaccgaaaaccgacggaactaccgtaccttaaccgtaagtacgtacggtacctaccgttaaacgttttaccggcgggtactaacgttacgttaacccgggtaccggggtaaaccggttccccggggtaaccccgttacgggaacccgttagtttacggtacgggtacggtaccggtacgggacccgggttacggttaacggggtaaccgtaacgggtttaacttttcccgaaacgttaccccggtacctaaacccccgtagtacccaaagggcgaacccgtttacggccggaaacgggttaccggtaaccgttaacgggaaagtttccggtagggtaacgtttacccggtttaagttttttaaccgtaacggtttacgaccgttaaacgggtaaccttaaaaaggttttaaccttaaacggttacccggtttaaacccgtacccgtttaccgggttaaaggccccgttttaaaccggttacccggggtttaaaccggggggaaccggtaaacccggggtaacggttaaacggggtcggtaaaaccggtttaaaccgaaaaccggtttaacccgggaacgtttaaccggggg

SEQ ID NO: 272123 - DNA, 914 bp, Homo sapiens
  misc_feature: GYAE6OF02IDOTR.13.39.D06.1.454.CMB.1.raw
  modified_base (169)..(169): a, c, t, g, unknown or other
  misc_feature (169)..(169): n is a, c, g, or t
  modified_base (267)..(267): a, c, t, g, unknown or other
  misc_feature (267)..(267): n is a, c, g, or t
tcagtcacgtactacacgaccggtgctcgatttagtgacatctcgcagttctttgggggctacaacaggcaggcaggggcagcaagagtggtgttgcagacccaggtcttcatttctctgttgctctggatctgtggtcgtcccgacggggtacagtcgtgatcgaccngtctccgagcctccgtggctgtctgtcggtgggacgaggacggcctaccgtatacactcggaccgacgtaccgagaccgtaggtagtttacgttttanaccgtacgacctaacctaaactaaaggtaacttaactttacgttacgttcgttacggtaaccacggaccaaacgtaaccggacgaccgtaccgtaacccgtaccgtaagccgttactaccgttacgtttaacgtttacgggaccggtactaaaccgtttccggtaccgggtaaccccgggtttacccgggttacccgggttacccgtcgggttaacccttagtttaccggaggttacggacgggttaccgggtacggggtcggtaacggtaccgtaacgttttacgtacgtccgtactacccgtaccgtagtaccctagggcttaccgggtccgtaacggtccggtaacggtaccgtttaggaacggttacggttacgggttaccggttaaccgggtttttaagtttaacccgtttaacggaccgtttaaacgggaacttttaaacggtttaactttaaccggtttaagtttaccccggttaaccggtttccccggttaacccggtaaggttttccccggttaacgggttttcccgggggtttaacggggaccccgggggttaaacggttaaacgggggtttaccggaacgggtttaaacccggtaaacccggtttaacgggtaaaccgggttccgtttaaccgggg

SEQ ID NO: 272124 - DNA, 1086 bp, Homo sapiens
  misc_feature: GYAE6OF02FIP6H.13.39.D06.1.454.CMB.1.raw
tcagtcacgtactacacgaccggtgctcgatttagtgacatctcgcagttctttgggggctacaacaggcaggcaggggcagcaagatgtgttgcagacccaggtcttcatttctctgttgctcgtggatctctggtcgacccgtacggggacatcgtgactcgacccagtcctccacgacctccgtggctgtcgtctacgtgggcgaggacgggacccaccgacgtccaaacgtcgacgtaacgtacccgaaccggaccgtaaggtacgtttacgtttttaacgtacccgtacggtaccttaacccaaaacgttaaaacgtaaacggttaaccttttacgttaacgttccggtttaccggttaacccgaacggtaacccgaacggtaaaacccgtaacggaaccgtaaccgtacccgttaaccgtaacgtaccgttacggtacctttaacgttacgtttaacggttacgggtacctaacgttaccggttaacggtacccggggtaaaccggttccccggggttaccccgtacgggtaacccgttaacgtttacggtaacgggttacgggaccgggtaacgggtacccggggtttacgggtaaccgggtaaaccggttaaccgtttttaacccgttacccgtttaacccgtttacccgtaaacctaaccccgttaacgtacccggtacgtacccggtaacccggttcccgggttaaaccggaaccggtaacccggggtttaaactaaccgggttaaacggttacgggtttaccgggttaccggttaccggtttttaaaccggtttttaaccggtttaacccggtttagggtttaaccctaaaccggtttaacgttttaaaagtttttaacccggtttaaaccggtttaaccgtttacccccgggtttaaccccgggttaacccgggtttaaccgggttccccgttttaaaacccgggttcccgggggttttaaaccccggggggaacggggtttaacccggggaaccgggttttaaaccggggacggtttaaaacccggttaaaccccggtttaaacgggaaaccggtttaccgggttacccgggg

SEQ ID NO: 272125 - DNA, 936 bp, Homo sapiens
  misc_feature: GYAE6OF02JIUNZ.13.39.D06.1.454.CMB.1.raw
  modified_base (167)..(167): a, c, t, g, unknown or other
  misc_feature (167)..(167): n is a, c, g, or t
  modified_base (371)..(371): a, c, t, g, unknown or other
  misc_feature (371)..(371): n is a, c, g, or t
tcagtcacgtactacacgaccggtgctcgatttagtgacatctcgcagttcgtttgggggctacaacaggcaggcaggggcagcaagatggtgttgcagacccaggtcttcatttctctgttgctctcggatctcgtgtcgccgacggggacatcgtgatcgacccngtctcagactcccgtggctgtgttccgtcgtgggacgaggacgggaccacattacaactcggacaacgtccaaggcctaaggtagtttggttttaacaccgtagtacctaccaaacgtaaaattaacggtaacctttacgttaacggtacctttaacgggtacctaacggtaccgtaaaacggtaaacccggtaggtaaacccnccgggttaaccccttaacccggtaagtcccggttttaccgtacctttaccgtttaaaaccgttttttccgggtacggggtaaccctaaacggttttacccgggtttaaaccggtaccccggggggttaacccgtttccccggggggttacccccgttaacgggttaaacccgggttaacgttttacccgggaacgggttcggtccggttaacccgggtacggggtttacggtaacgggggacccttttaaacgggtaaccttttcccgttaacccgtacttacccgtaaaccgttaacggttacccgaacggtccggtacgtaacccgggttcgtaccggttaacgggtacttaaccgggagggttaacgtacggggttacggtacgtttaaccgtttaaggttacccgtacgtaacgttactaacgggtaactttaaccgttagttaaacccgttgttacccggttacgaaccgttggtttaaccccggtaggtttccgggaaccgggtaacgggtacccgttaggggtaaccgtagtaacggtaccgtaaccgtggttaacgg

SEQ ID NO: 272126 - DNA, 854 bp, Homo sapiens
  misc_feature: GYAE6OF02FFY63.13.39.D06.1.454.CMB.1.raw
  modified_base (822)..(822): a, c, t, g, unknown or other
  misc_feature (822)..(822): n is a, c, g, or t
tcagtcacgtactacacgaccggtgctcgatttagtgacatctcgcagttctttgggggctacaacaggcaggcaggggcagcaagatggtgttgcagacccaggtcttcatttctctgtgctctggatctcgtggtgcccacggggacatcgtgatgacccagtctccagactccctggctgtgtctcgtagggcgagaggggtccaacccgtatccaaacgtcgacctaaaggttccacggcctagaaggttgtttttaacaaccacggccttacccaaactaaaagtaacggtaacctttacgttaacgtcgtttacgggtaaaccctaggaccaacgaaaaccacgggtaacacggtaccctacccgttaagaccgtcgaccttaccgtaacgtttaccgtcggggactagttccgttaaacgtaccggggaaacttccccggggacccttagggaccccgttattacaacggttcgggaccgtaaggtccggggttacgtacggggtactaacggtactttaccgactttaccgcctaaccgacgttacgtaccgccaccggttcctacggtaccgtcgggtacttagggaaaccggttacgttagggtttaccggtaccggttaaacgttttttaccggtaacgttcgttaccggaaacggtttaccgttaaaagtttaacttaaacggtttaccgtttacccgttaacccggttaccggtaacccgggtcctttaaccggttaacccgttttcccgggggtaaacccggttaacggggtaaccccgttaagggggtttaccggaaacgggtttanaaccccgggttaaaccggtaaccgtttacggg

SEQ ID NO: 272127 - DNA, 835 bp, Homo sapiens
  misc_feature: GYAE6OF02JM0X7.13.39.D06.1.454.CMB.1.raw
tcagtcacgtactacacgaccggtgctcgatttagtgacatctcgcagttctttgggggtcgtacaacaggcaggcaggggcgagcaagatggtgttgcagacccaggtcgttcatttctctgttgctctggatctcgttggtcgtcccggacgggacctagtcggtgacgtcgacccacgtctccgacgcctcccgtgccgtgtcgttcgtcctgggacgtacgggacggccctaaccagtcaaccgttcggacctaacggacccacggaccctaaggtacgtttacggtttttaacgaacgaaccgtaccttaaccccaaaataaaacgttaaacgtaaacccttttcgttaacgtacgttacggtaacccctaagtaaccggaaacgtaaaacccggacggtaaccgtaaccggtcctaacccgttaagaccgtttggaccttaacgttacgttttaacggtaccggaccgttagtacccgttaaacggtccccggggtaaacggttcccccgggttacgttacccgaacgttacgtttaaccggacggtcggtaccggtaacggtcccggggttcacgggggtacctaaggtaaccgtttcgtaacccgtaccttacccgaactacgcgtacgaccgtacgtaccgttacgacgtacggtactaagaaacgtgtcgtaaggttccgtaagttttaaacctgttaccgtgtaaactaacgttaattaacgtaacctttaagtacccttaccgacgaacggtctaacccgttcggtttacgacgggtagtaacccggtaggttccggaagtagtaaacccgacggtaatcggg

SEQ ID NO: 272128 - DNA, 783 bp, Homo sapiens
  misc_feature: GYAE6OF02GH5TY.13.39.D06.1.454.CMB.1.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
tcagtcacgtactacacgaccggtgctcgatttagtgacatctcgcagttctttggggagcttcagctgtggtagagaagacaggattcaggacaatctccagcatggcggcttccctctcctcctcaccctcctcactcactgtgcagggtcctagggcccagtcctgtgctgactcagcccacctcagtccgtctacggggaccccccgggnacggaggtccacctactcttcgttcgtactggaagtcgagtccttaccaacncgtacgaagtaattntagtatagttaggtactnacgtcagtcctaccgaggaaccggtccccaaaactcggactacgactaccgtaagtacggaaataacttcgaacggccgtaccgtacgtaccggggtccctagaaccggtcttacgtcgttaccggccaacctacgcgttacggacctacccgtacacggccccttaccgtacggccctaacgtccggtaaggttccgggtaccgtaccccgggtaccgaagggttaacgtacggtacgggttacctagggtttaaactttcgttaaccgttcgggttacgacggtttacccgaaggtaaccggttcgggtaaactaccgggtaaactacccgggttaccgtaaggtttcggggtaaccgggtttcccgggttaagggttacccggggaaccggggtaaccgggtaaaccccgtacgggttacccttaacgggttacccccggttaacgggttaccgttaccgggaaccccggttaaccccggg

SEQ ID NO: 272129 - DNA, 756 bp, Homo sapiens
  misc_feature: GYAE6OF02IWEAR.13.39.D06.1.454.CMB.1.raw
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
  modified_base (475)..(475): a, c, t, g, unknown or other
  misc_feature (475)..(475): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacagtcgtgatgacccagtctccagacctccctggctgtgtctcgtgggcgagacgggccaccgatcaactgacaacgtccagccaagacgttgttttacgacagccttaccaaactaaataacgtaactttcttaagtctttacggtacctagacaacgaaacccgaggaaccgacgccctaccgtaacgcgtacgcttactaacttttacgngggactacgttctacggtaccgggtaacgtcccgggtaccctacgacccgtnttacgagtcggcgaggtccgggtcgtagggaactagtctttaccgacctcgtaccaccgtancagacctacgtctcgaccgtaggtccgtagtaacgtacgttggtacggtaccgtttaagttttaacgttacgttacgttacgtaacgtacgttaaaacgttttagttaaacgtttaaccgttaacccttacccgggttacccgtaacggggttccccttaaccgggtttacccgggtttacccgggggaaccgggggttaaacccgggttaccgggttaaacggggtacggtaaccggtaacccgtaaaccggttaaaacccggggtcgtttaaccggggg

SEQ ID NO: 272130 - DNA, 747 bp, Homo sapiens
  misc_feature: GYAE6OF02FKMX7.13.39.D06.1.454.CMB.1.raw
  modified_base (575)..(575): a, c, t, g, unknown or other
  misc_feature (575)..(575): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtcgcccgacggggacatcgtgatgacccagtctaccagtacctcccgtggcctgtgtcgtcgtgggcgaggacgggccaccactaccaacgtgacgaagtcccgacgaccaggtaagttgttttaacacgtacgacctaccgtaaactaaacgttaaacgtaaacctttacgttaacgttccgttacgggtaaccaacgtaacgaaacgaaaaccgacggtaaccgaccggtacccctaaccgtaacggccttaccggtactttaccgtaaccgtttaacgtacgggaccttaaccgttacgttaaccggtaccgggtaaccgttcccgggtacccgtacggtaacgttacgttacgtaacggtcggtaccgacggtaccgggtcgtacggtaacgtagtttacgttccgacctacctcgaccagtccgagccgtaacnccgacgtcgacgttagacgtaagcgttgggtcgtacgtttagttacgtctacgtactaacgacttaataacgttacttaacgacctttaccctcggaacgttcgtaacgttaccggttccggaacgggacggttaaccggagtaccggaagtacctaaacgagtctaacggg

SEQ ID NO: 272131 - DNA, 730 bp, Homo sapiens
  misc_feature: GYAE6OF02GKYFR.13.39.D06.1.454.CMB.1.raw
  modified_base (440)..(440): a, c, t, g, unknown or other
  misc_feature (440)..(440): n is a, c, g, or t
tcagtcacgtactacacgaccggtgctcgatttagtgacatctcgcagttctttgggggctacaacaggcaggcaggggcagcaagatggtgttgcagacccaggtcttcatttctctgttgctctggatctctggtgcccgacggggacatcgtgatgacccagtctccgagtacctcccgtggctgtgtctcgtgggcgaggacggccaccagtcaacgtgcaacgtccgacgaccgagtagttagttttaacacgacgtcctaccaaacaataaacgtaaccttcttacgtcttacggtaccagtacaacgaaacccgaggaaccacgtcccacctaacgtcgtcgccttacgtacgtttacgtcgggtctacttacgtaacggtaccgggtaccgttccccgggttcctacgtacgtacttcgaaggtcggaccgngggtccggtcggtacgggaccgtacggttactttcccgaccgttcctaccgaaccttcgtaaccgacgtaccgtaccgtaccgttacggacccgtaacgggcgttaaaggaacgtgttcgggacgttacttaaacgggttttacctacggtacgtctaaacgttacgtaagtttaactaacgttaagtccccgttaccgaccgtaccggttcttaacggttcccggttaccgggaagggttaccgtaagggagggttcgaacgtaacgtaacgtaaccgggtactacggg

SEQ ID NO: 272132 - DNA, 787 bp, Homo sapiens
  misc_feature: GYAE6OF02FVU2K.13.39.D06.1.454.CMB.1.raw
  modified_base (251)..(251): a, c, t, g, unknown or other
  misc_feature (251)..(251): n is a, c, g, or t
  modified_base (580)..(580): a, c, t, g, unknown or other
  misc_feature (580)..(580): n is a, c, g, or t
  modified_base (588)..(588): a, c, t, g, unknown or other
  misc_feature (588)..(588): n is a, c, g, or t
tcagtcacgtactacacgaccggtgctcgatttagtgacatctcgcaggttctttgggggctacaacaggcaggcaggggcagcaagatggtgttggcagaccaggtcttcatttctctgttgctctggatctctggtcgccctaggggacatcgtgaatggaccctagtcctcacgactccctggtctgtgtctcgtgggacgagcggccacactcaactcgacaacgtccaagccagtagtcgttttanacacgctaccaactaagtaaacgtaacctttcgtttaacgcgttacggttaacccaggaccgtaaacggaaaaccgtaggaaaccctaccgttaccgtaaccgtaacggttaccgtacggtaccttacgtaacgtttttaaccggcggggtccttaagttacccgttaacggttaccggggtaaccggtttccccgggtacccttacggggtaacccctagtttaccggacggtacggacgtaacggggtccggtacgtagggtaaccctcgggtttacttaccgtacttacgttaacccacgttaacgactagtaccgcgttaaccgngtaaccgnggttaccgttagaaacgtgttacgggacttagttaacgtttaacttacggttacgacttacggacctagggtacgttacgtaccgtacgtaccggttccccgttaccggtacccgggtttcggggaccggtaaacggcccggttaaaggtacggaacggttcaaaccggttaacggtacccggtagttaccggaaccgg

SEQ ID NO: 272133 - DNA, 781 bp, Homo sapiens
  misc_feature: GYAE6OF02FHNGB.13.39.D06.1.454.CMB.1.raw
  modified_base (139)..(139): a, c, t, g, unknown or other
  misc_feature (139)..(139): n is a, c, g, or t
  modified_base (344)..(344): a, c, t, g, unknown or other
  misc_feature (344)..(344): n is a, c, g, or t
  modified_base (396)..(396): a, c, t, g, unknown or other
  misc_feature (396)..(396): n is a, c, g, or t
  modified_base (686)..(686): a, c, t, g, unknown or other
  misc_feature (686)..(686): n is a, c, g, or t
tcagtcacgtactacacgaccggtgctcgatttagtgacatctcgcagttctttgggggctacaacaggcaggcaggggcagcaagatggtgtgcagacccaggtcttcatttctctgttgctctggatctcgtggtcncccggaggggactatcggtgactcgacccgtagtccgtccacgtacctcccgtggtacctggttgtccgtcgtcgggccgaggacggacccactagtcctaacgcgactaacgtccgacgcgaagtagtttgtttacgaccagtacctaaccaagaataacgttacctttctagtaccgttcgtaacagtcgaaacgaaaccggngtaccaaccgtaccctacgtaacgtccgtagtaccttcgtaacgtttacggngtccttacgtaccgttaacggccccgggttaaccgttcccgggttacccacggtactaaccgtttccgaagggtcccggtaagtccggggtacccgggtttaccgtagggtacctgtttaaacccgtccggtacctttaaccgtaacctaacggacttcgaaccgtccggcgtacccggtacgaacgtcggacgtaaaggcgttcggttacggtacggttaaccttttaggtttaaccttccgtacgttaccgtaaactagtttaaacgtagtttaccaccggtttaccncccggtaacgttctaccgggttcccttacggggtacgacggtaaccggacggaaggttccgtaaacgtaccggtaaccgtaagggttaccctggg

SEQ ID NO: 272134 - DNA, 699 bp, Homo sapiens
  misc_feature: GYAE6OF02HU5KD.13.39.D06.1.454.CMB.1.raw
  modified_base (159)..(159): a, c, t, g, unknown or other
  misc_feature (159)..(159): n is a, c, g, or t
  modified_base (164)..(164): a, c, t, g, unknown or other
  misc_feature (164)..(164): n is a, c, g, or t
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (370)..(370): a, c, t, g, unknown or other
  misc_feature (370)..(370): n is a, c, g, or t
  modified_base (536)..(536): a, c, t, g, unknown or other
  misc_feature (536)..(536): n is a, c, g, or t
  modified_base (556)..(556): a, c, t, g, unknown or other
  misc_feature (556)..(556): n is a, c, g, or t
  modified_base (571)..(571): a, c, t, g, unknown or other
  misc_feature (571)..(571): n is a, c, g, or t
tcagtcacgtactacacgaccggtgctcgatttagtgacatctcgcagttcgtttgggggctacaacaggcaggcagggcagcaagatggtgtgcagacccaggtcttcatttctgtgttgcctgtggacttctgtggtcgcccgaagggctaagtcgngtacncggacctcgtccgtacacgaccttcccgnggtctgtcggtcttcggcgggacgtggcggccaacgtntaaccgactcgaccacgtccncgtacaacggttacgttctttaaanccgtagaccctaccaaataactaacgtaccttgtcgcgttaccggttaacacgacgaacgaaacgtcggtaacaccgtccctagttaaaccgngtttacgccgttaccgttaaagttccgtaagggactttaccggtgtaccgttaccgggtacgggccccgttaacgactaccgttagtacggtcgccggtaggcgtttcgggtacaacggggtctaacgtctaacctcgtcgtacgtcgaactgcaacggctacgcncgtagctagatcggtatcgnttacgttgtcgtacnccgtaagttccaagtttactacgtaacgtccgtaccggttgacgttaccggtccgttacgggaccggtacggtaaccggtacggacgggttacgtaaccgacgtttaaacgacccgttagtaacccgg

SEQ ID NO: 272135 - DNA, 688 bp, Homo sapiens
  misc_feature: GYAE6OF02GXZTI.13.39.D06.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (565)..(565): a, c, t, g, unknown or other
  misc_feature (565)..(565): n is a, c, g, or t
tcagtcacgtactacacgaccggtgctcgatttagtgacatctcgcagttctttgggggctacaacaggcaggcaggggcagcaagatggtgttgcagacccaggtcttcattttctctgttgctctggatctctggtgcccagggacatcgtgatgacccagtctccagactcctggctgtgtctcgtggcgagnggccacatcaactgcagtccagccagagttgtttaanacgagcctacaactaaatagaacttctagcttcggtaccagtacaacgtaaaccaggaccaggcccttaccgtaagcctagccttctaattttcgcggctacgtcgtaaccgtaccggggaaccgttccccgggtacccgtacggtaccgtagttccgtaaggtcggacgtacgggtaccggttcggaacggggtactaacgggttactttaccgaccgtttcccttacccgaaccgtactaccgtacgacgttaccgccgttagaccgtacggtaccgtaggaacgtgtacggtcgtaccgtttagtttacttacgttacgactaacggtnttaaacgttaagtttacgtaaacgttccctaccgtacggtacgttaccgtcgttaaccggtttcgggaacggtaccgggtaacgaggttaccgggataaccgtaacgaaccggtagttacggg

SEQ ID NO: 272136 - DNA, 786 bp, Homo sapiens
  misc_feature: GYAE6OF02JRPWE.13.39.D06.1.454.CMB.1.raw
  modified_base (227)..(227): a, c, t, g, unknown or other
  misc_feature (227)..(227): n is a, c, g, or t
tcagtcacgtactacacgaccggtgctcgatttagtgacatctcgcagttctttggggagcttcagctgtggtagagaagacaggattcaggacaatctccagcatggccggcttccctctcctcctcaccctcctcactacactgtgctaggtcctggcccagtctgtcgactcgacctcgacgccctaacccgtcacgtccgttcggtaccggggaccccccggnaacgggtacgggtaccaccgtaactccttctttacgttccgtaggtaacgacgtaacggtcctaacccgtaaacgtacgttaaccggggtaaattaaacgtttaagtacgttaaagtttacgtttaggtaacttcgaacggtacgaacggtccctaacccggaacgggtaaccccggaaccccaacgtacgtcctacctattaccgtaagtaaacgacttaacgacgtacggccgtaccgtacggtacggtaccgtcgacgttacgttctaccggtcgtacctaacgtacgtccgtacgtacctcctaacgcctacccgtcccgtacggtacctcgtaccgacgggtcgtcccgttaccgggtaccgaaggtccgtaacggccgttacgtactaaagtttaccgtagttcgacggactacggtacgtacgggtacggacgttacgaacgtaccgtacgtagggttccgtaacgggtcccggttacggggtacggacggggttaaaccgtaccggaacgtccggttacgaccggttacggtacggtacgtacccgtacgg

SEQ ID NO: 272137 - DNA, 753 bp, Homo sapiens
  misc_feature: GYAE6OF02JX4L9.13.39.D06.1.454.CMB.1.raw
  modified_base (386)..(386): a, c, t, g, unknown or other
  misc_feature (386)..(386): n is a, c, g, or t
tcagtcacgtactacacgaccggtgctcgatttagtgacatctcgcaggttctttggggagctacaacaggcaggcaggggcagcaagatggtgttgcagacccaggtcttcatttctctgttgctctggatctctggtcgccgacggggcatcgtgatgacccagtctccagacttcctggctgtgtctcgtagggcgagacgggtacccactaacgtactaaccgtgacccgtaagtaccgaacgtacccgaagtacggtttacgtttttaagaacctacggttcctacccaaaataaacggtttaaacaaccgttttacctttagtaccgttacggttaaacccaggtactaaccggaaaaccgacggaaccagtacccctanaaccgtcgtagacctacgtagtttaccgcggtactaagtcgttaaggtcccgggtaacttccccgggggtcctagtacccggttatttaccgaaggttcggaacggtagggcccgggttagacggaaccttgtaccgtttacctacccgtcctaaccgtaccgtaagttacccggacttacggaaccgttccgtacgaaccgttaggtacggtaaacggtaagttaaacggttcggtacggtactttaacggttttagtacccgttaaggtcctaacgtatacggttaataacgttactactcgttaccaggtacctcgttacggttcgaacggtcgacgaggtacgacgtacgtgtaaacccgtag

SEQ ID NO: 272138 - DNA, 795 bp, Homo sapiens
  misc_feature: GYAE6OF02GPXH9.13.39.D06.1.454.CMB.1.raw
  modified_base (258)..(258): a, c, t, g, unknown or other
  misc_feature (258)..(258): n is a, c, g, or t
tcagtcacgtactacacgaccggtgctcgattttagtgacatctcgcagtttctttgggggctacaacaggcaggcaggggcagcaagatggtgttgcagacccaggtcttcatttctctgttgctctgatctctggtcgcccgacgggacattcgtgatcgaccctagtcctccacgacctccgtgtctgtcgtctgtgggacgaggcggaccacactacactgacacgccacgaccgtagtagtttacggtttaanaccgacgtcctaaccgaaactaaattaaacgtaacctttagtacgtccgtttacggaacccacgtaacgaaccgaaaccgacgaccgtacgtaccctaaccgtacgctacgtaccttacttacgttcggtacggtacttacgtacgtaaccggtaccgggttaccgttcccggggtacctcggaaccttacggtacggtacggtacggtaccgtacgggggtacccggtttacgacgggttaagtaccgtttactttacccgtaccgttaccacccggtaacctcggtacgtaaccgtccgtaaaccgtcccggttaacgcgggtaaccgggttcgtaaacggttaacggtccggttagggttaacggttacggtttttaacgtttaacggttccgtaacgtttacgaaacgttacgtttaattacggtttaaacctcggttacccgtaaccggcgttacgtttccgtaaccgttacgggttacggtacggaggtaaccgtacggacggttaacgccgtaaacgtacggtgtaaccg

SEQ ID NO: 272139 - DNA, 503 bp, Homo sapiens
  misc_feature: GYAE6OF01EHFAI.17.49.E05.1.454.CMB.1.raw
  modified_base (491)..(491): a, c, t, g, unknown or other
  misc_feature (491)..(491): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtactcccagccaggttcagtggcagtgggtctgggacagagttcactctcaccatcagcagcctgcagtctgaagtattttgctagtttattactgtcagcaatataatgtactggcctcgctctacgttcggcggtagggaccaagggtggagatcgaaacgacgtggnggctggcactac

SEQ ID NO: 272140 - DNA, 494 bp, Homo sapiens
  misc_feature: GYAE6OF01AYIBX.17.49.E05.1.454.CMB.1.raw
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtgcagtgggtctgggacagagttcactctcaccatcagcagcctgcagtctgaagattttgctagtttattactgtcagcaatataatgtactgctcgctctacttcggcggaggaccgtaggtggagatacgaaacgactgtaggatgcacgta

SEQ ID NO: 272141 - DNA, 532 bp, Homo sapiens
  misc_feature: GYAE6OF01BY74Z.17.49.E05.1.454.CMB.1.raw
  modified_base (204)..(204): a, c, t, g, unknown or other
  misc_feature (204)..(204): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcagaaacctggccaggctcccaggctcctcatttatggtgcatccaccagggccactggtactcccagccaggttcagtggcaggtgggtctggggacaggtagttcactctcacccatcagcagcctgcagtctagaagtattttgcttagttttattactgtcagtacaatataatgtactcggcctccgctccgtacgtttcgggacgggtagggaccgtaagggtaggaggtactacgaaacgacgtggtggactcgcgacctacg

SEQ ID NO: 272142 - DNA, 540 bp, Homo sapiens
  misc_feature: GYAE6OF01A94XD.17.49.E05.1.454.CMB.1.raw
  modified_base (418)..(418): a, c, t, g, unknown or other
  misc_feature (418)..(418): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccgaggcctcctcatttagtggtcgcatcccaccgacgggccacgtcggtactcccgagccctaggttcaggtggcgtaggtgggtctgggactagtagttcactcgtcacatcagcacgcctgcagtctagaagtntttgctagtttatacgtgtacagataatatagtgtactcgtccctcgctactacgttccgggacggacggaccgtaaggtggaagtacgtaacgaaacgtacgtggtacgctcgctcgtacg

SEQ ID NO: 272143 - DNA, 498 bp, Homo sapiens
  misc_feature: GYAE6OF01D00WP.17.49.E05.1.454.CMB.1.raw
  modified_base (298)..(298): a, c, t, g, unknown or other
  misc_feature (298)..(298): n is a, c, g, or t
  modified_base (495)..(495): a, c, t, g, unknown or other
  misc_feature (495)..(495): n is a, c, g, or t
tcagcgtagactagcacgaccggtgctcgatttagagcgactagcaacacacaaaggggaggaactactcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttanggtgcatccaccagggccactggtatcccagccaggttcagtggcagtggtctgggacagagttcactctcaccatcagcagcctgcagtctagaagtattttgctagtttattactgtcagcaatataatgactgcctcgctcacgttcggcggaggaccgaaggtcggagatcgaaacgtactgtgctgctccgntcg

SEQ ID NO: 272144 - DNA, 583 bp, Homo sapiens
  misc_feature: GYAE6OF01DBJT2.17.49.E05.1.454.CMB.1.raw
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagcccaccctctcctgcagggccactcagagtattaccagcaacttagcctggtaccagcagaaacctggccaggctccaggcctcctcatttatggtncatcccacagggccacgtggtacncccagccaggttcaggtggcaggtgggtctgggacaggtagttcacttctcacctatcagcacgtcctgctagtcgtagtagttagtttgacttagtttacttacttgtactagtactaattaattaatgtacgttcggtacccgttccgtccttaccgtaccgtttcgggaccgggtacgggtaccggtaaagggtacgggaagtaacgtaaccgtaaacggtaacgtcggttacggactacgccgtaccgtacg

SEQ ID NO: 272145 - DNA, 762 bp, Homo sapiens
  misc_feature: GYAE6OF01CMD8I.17.49.E05.1.454.CMB.1.raw
  modified_base (208)..(208): a, c, t, g, unknown or other
  misc_feature (208)..(208): n is a, c, g, or t
  modified_base (330)..(330): a, c, t, g, unknown or other
  misc_feature (330)..(330): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtcctgtgtcctccgaggggaaacncgcccaccctctcctgccgacgggccactcgagtagtactaccgagactaacttacgcctaggtaccagacaacgaaaccgtcggaccaggcctcccgaggccttcctactatttagcggtncctactaccaaccgacggcctacgtcggtactcccgagtccgtaggttacaggtcggacgtaggtcgggtcgtacggggactaggtacgttcacgtcctccaacgtagtcgacgtcacgtccgtacgaccgtaacgttcgtaaggtaacgtttacgttttacggaccgtttaaggttttacttaccgtaggttactaacggtaaccttaaagttaacgttaacggttaccggtaaccgttccgggtaccccttacccggttacgttaacccggtttaacgggtttcccggggaaccgggttaacggggttaaaccccggtaagggggttaccggtaaacgttaacccggttaaaccgggtaaaaaccgggttacccggtttacggggttaccggtaacccgtttacggtaaccccgttaacccggtttacgg

SEQ ID NO: 272146 - DNA, 948 bp, Homo sapiens
  misc_feature: GYAE6OF01DFP8Q.17.49.E05.1.454.CMB.1.raw
  modified_base (206)..(206): a, c, t, g, unknown or other
  misc_feature (206)..(206): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtcgtctccgaggggaaancgccaccctctcctgcagggccactcgagagtacttaccagactaaacgttacgcctaggtaaccaggacaacggaaaacctcgggacccaacgggtccctaccccgaggtcccttaccctacgtaattttacgtcgggttacgacctaccgttacccgaaccgacggggtacccctaacggttcgggtaaccctccccgaacgggtacccgttaaggggtttaccgaagggttcgggaccgtaaggggttcggggtaccgttacgggggaactaacgggttacggtttcccaaccgtttaccgtacccgtaaaccctagttacccggaacggtcccgtaaccggtccccgttacgggtaccgttaaacggtttaccggtaaacgggttaaacggttttacggtttttttacggaacccgtttttaaagggtttttttaaaccgtttaacccggtttacgggtttaaccgtaaacgggttaaaccctttaaaaaggttttaacgtttaaacggtttacggggtttaaacccgtttcccgggggtaaccccttttaccccggggtaccctttaacccgggtttacccgggttttaccgggggaaccccgggggttaaacggggttaaaccccgtaaaggggggttaccggaaaacggttaccgttaaacccgggtaaaaaaccggttaccggttacggggtaaccggttaccggttaccggaacccgttaacccggtttaacg

SEQ ID NO: 272147 - DNA, 669 bp, Homo sapiens
  misc_feature: GYAE6OF01EJXC3.17.49.E05.1.454.CMB.1.raw
  modified_base (206)..(206): a, c, t, g, unknown or other
  misc_feature (206)..(206): n is a, c, g, or t
  modified_base (654)..(654): a, c, t, g, unknown or other
  misc_feature (654)..(654): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggcctcccagataccactggagaaatagtgatgacgcagtctccagccaccctgtctgtgtctccgaggggaaancgcccaccctctcctgcaggccactcagagtataccagcaacttgcctggtaccagacacgaaaccgtggaccacggctccccgaggtccttccctactagttttagtggtcgcgtacctcccgaaccgtacgggaccctacgtcgggtactcccgagcccgtaggtcaggtggcgtaggtcgggtcgtagggactaggtacgttaccactcctacaccgtataccgacgacgacgcccgtagcgtaacgttcgtaggtaagttacgttttacgtaccgttagttttaacgttacgttaggtactagtaacttaattaagtaacgttacgtacgttcccgggtcccttacccggtcctaccgttaccggttccggggaccggtaaccgggtaacgtaagggtaggaacgtaacgtaaccgtaaaccggtacgttcggacggttacccngtacccgtacctacg

SEQ ID NO: 272148 - DNA, 554 bp, Homo sapiens
  misc_feature: GYAE6OF01CZZT8.17.49.E05.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (382)..(382): a, c, t, g, unknown or other
  misc_feature (382)..(382): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccactcagagtattaccagcaacttagcctggtaccagcagaacctggccaggcctcccaggctcctnatttanggtgcatccacagggcccacgtggtactccccgagcccaggttcaggtggcaggtgggtctgggacagcgttcactctcaccntcagcagcctgcagtctagtaagtattttgcttagttttattactgtcagtacaattataagtgacgttcggcctccgtctccgtaccgtttcgggaccgggtagggaccgtagggtagggagtacgtaccgaaaacggtaacgtggtacggaccgtacgccgtaccgtacg

SEQ ID NO: 272149 - DNA, 1038 bp, Homo sapiens
  misc_feature: GYAE6OF01CQB38.17.49.E05.1.454.CMB.1.raw
tcagcgtagactagcacgaccggtgctcgatttagagcgactagcaacacgacgaaaggggaggaactgctcagttaggacccagacggaaccatcggaagccccagcgcagcttctcttcctcctgctactctggcctcccagataccactggagaaatagtgatgacgcagtctccagccaccctgtctgtcgtctccgaggggaagcgcccaccctctcctgcgagggccactcagagttacttaccgagctaacttacggccgtggtaccacgacaacgaaaccgtggaccaggcctacccgagggtccccttacccgtacgtaagttttagtcgggttacgacctaaccgttaccccgaacccggtacgggggtcccctaaccggttacgggtaaccttacccccgaagggtaccccgtaacggggtttccgaacggggttcggggaccgtaggggttcggggtaccgtacgggggaacctacgggtaccgttttaccgaacccgttaccgtacccgaacccgttaacgttaccgaaccggtacccgtaaccgggttaccccgttacggggtacccgttaacggtttacccggttaagggttaaaccggttttacggttttttacgggtaccggtttttaaccgggttttttaacggtttaacccggtttacgggttaacccggttaaaccggttaaaccgttaaaaccggttttaaacgttaaaccggtttaccgggttaaaccccggtttacccgggggttaccccccgtttacccccgggttaccccgttttaaccccgggtttaaccccggggtttttaccccggggggaaacccggggggttaaacccgggggttaaacccccggggtttaaaaccggggggttaccccgggggttaaaacccgggttaaaaccccggttttaaacccccgggtaaaaaaaccgggtttacccggggttaacgggggtttacccggggttaacccgtttaacccggggaacccccgttaaaccccgggtttaacccgg

SEQ ID NO: 272150 - DNA, 581 bp, Homo sapiens
  misc_feature: GYAE6OF01B8FHP.17.49.E05.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (443)..(443): a, c, t, g, unknown or other
  misc_feature (443)..(443): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtataccagcaacttagcctggtaccagcagaacctggccaggctcccaggctcctcatttatggtncatcccaccgagggcccacgtggtactccccgagtccctagggttccaggtcgggctaggttcggggtctagggggactagggtaacgtttccacttcgtaccaacctatcaacgccgagtccctgacctagtactagaagtnttttgacttagttttattactgtcagtacaattataagtgacgtcggtccctccgctcgtacgtttcgggccggtaacgggaccgtaagggtggaacgactacgaaacgtaacgtggtacggactcggcctaccgtac

SEQ ID NO: 272151 - DNA, 555 bp, Homo sapiens
  misc_feature: GYAE6OF01DPRUO.17.49.E05.1.454.CMB.1.raw
  modified_base (298)..(298): a, c, t, g, unknown or other
  misc_feature (298)..(298): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggcctccaggctcctcatttanggtgcactccaccgagggcccagtcggtactcccgagccaggttcaggtcggcaggtgggtctgggacagtacgttcactctcaccatcagcacgcctgctagtctagaagttattttgacttagtttattacttgtcagtactaataataagtcgtactcggtccctccgtcttcgtaccgttcgggacggtacgggaacccgtaagggtggagtacgtaaccgaaacggacgtggtacggctacgcctaccgtac

SEQ ID NO: 272152 - DNA, 543 bp, Homo sapiens
  misc_feature: GYAE6OF01BYUDN.17.49.E05.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (406)..(406): a, c, t, g, unknown or other
  misc_feature (406)..(406): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcagaacctggccaggcctcccgaggcctcctcatttatggtncatccaccgagggcccactggtactcccagccaggttcaggtgcaggtgggtctgggacaggagttcactctcacctatcagcagcctgcagtctagaagtntttgctagtttattactgtacagtactaattataagtgtacgtcggtcccttccgcttccgtacgtttcgggacgggtacgggaccgtaagggtggaagtacgtaacgaaacgacgtggtcggactcgccgactacg

SEQ ID NO: 272153 - DNA, 715 bp, Homo sapiens
  misc_feature: GYAE6OF01C2QUY.17.49.E05.1.454.CMB.1.raw
  modified_base (174)..(174): a, c, t, g, unknown or other
  misc_feature (174)..(174): n is a, c, g, or t
  modified_base (219)..(219): a, c, t, g, unknown or other
  misc_feature (219)..(219): n is a, c, g, or t
  modified_base (406)..(406): a, c, t, g, unknown or other
  misc_feature (406)..(406): n is a, c, g, or t
tcagcgtagactagcacgaccggtgctcgatttagagcgactagcaacacgacgaaaggggaggaactgctcagttaggacccagacggaaccatggaagccccagcgcagcttctcttcctcctgctactctggctcccagataccactggagaaatagtgatgacgcagtcnccagccaccctgtctgtgtctccgaaggggaaagcgcccaccctntcctgcgacgggaccactacaggtacttacttaacccgagactaacgttacgacccgtacggtaaccacgacaaacgaaaccgtcggaccgaacggtaccttaccccgaaggtccttccctacttaagtttaaggtcggtacgacctaacgtcccgaacgacggggaccctaacgtacgggttaccnccccgaaggtcctaaggttcaaggtcgactaggtcggtcgagggacaagcggtttcacgtctccgaactactcgacgcgaacgccgtacgacgtacgtaccgttaggtaacgttagttttcggaactttagtttaacgttacgttacgtactaggtaactaaacttaataacgtacgtacgtaccggtacccgttaccgtcctaccgttacggtttaccggaccgggtaacggaacccggtaagggaccggtaacgtaacgtaaccgtaaacgtacggttggtacgccggttacgaccgtacgttaacg

SEQ ID NO: 272154 - DNA, 575 bp, Homo sapiens
  misc_feature: GYAE6OF01CFIVT.17.49.E05.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccactcagagtattaccagcaacttagcctggtaccagcaagaaccctggccaggcctcccgaggcctcctcattttagnggtcgcactccgaccgacgggcctacgtggtactcccgagcctaggttcaggtggcaggtgggtcgtagggactaggtacgttcacttctacacctntacagcacgtcctgcagtctagtaagtntttgacttagtttattactgtcagtactaatataagtcgacgttgccctcgcttcgtacggtttccgggaccgggtaagggaccgtaagggtaggtaacgtacgtaaccgtaaacggtacgtggtacggctacggacctacgtacg

SEQ ID NO: 272155 - DNA, 659 bp, Homo sapiens
  misc_feature: GYAE6OF01C2CU8.17.49.E05.1.454.CMB.1.raw
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagacgccaccctctcctgcacgggccactcgagagtacttaccgagctaacttagcctggtaccagaccaacgaaaccgtcggaccaggcctacccgaggcctcctctatttagnggtcgcacgtcccacgacggcctacgtggtacncccgagcctaggttcaggtcggacgaggtgggtcgtcgggactaggtacgtttcaccttcgtaccaccgtatacgagacctacgtccctgctacgtcgtaagtagttacgtttcgtacgtttacgtttatttacgttagtactagtactaaagttaattaacgtcgtaccgtacggtcccttaccgtccttacgttaccggtttaccgggacggggtaacgggtacccggtaaggggttggtaacgtaacgttaaaccgaaacggttacggttacgggtacggtactacggaaccctaccgttaccg

SEQ ID NO: 272156 - DNA, 582 bp, Homo sapiens
  misc_feature: GYAE6OF01BFPEV.17.49.E05.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccactcagagtataccagctaacttagcctggtaccagcagaacctggccaggctcccgaggcctcctctatttatggtncatcccaccgacgggcctacgttggtactccccgagcccgtaggttcagtcggcgaggtgggtctgggacagtacgttcactctacaccgtatcagcacgcctgccagtctagaagttntttgcgttagtttactactgtacagtactaattagtaagtcgtacgtcggtccctaccgtccttaccgtaccggttcgggccgggaagggacccgtaaggggttaggacgtacgtaaccggtaaacgacgttcgggtacgacctcggaccgtacgtacg

SEQ ID NO: 272157 - DNA, 748 bp, Homo sapiens
  misc_feature: GYAE6OF01D7L31.17.49.E05.1.454.CMB.1.raw
tcagcgtagactagcacgaccggtgctcgatttagagcgactagcaacacacaaaggggaggaactgctcagttaggacccagacggaaccatggaagccccagcgcagcttctcttcctcctgctactctggcctcccagataccactggagaaatagtgatgacgcagtctccagccaccctgtctgtgtctccgaaggggaaagacgcccaccctctcctgccgagggccactcagtagtattaccgagactaacttgcctcggtaccaggacaacggaaaccgtcggaccaggtccctcccgaaggtcccttaccctacttaagtttttacgtcggggttcaaccgtacgtaccccgaacccgggtaccggggtacccctaacggttccgggttaccctaccccggaggtccccgttaagggtttccgaacggggttcgggacgttacggggttggggttaccggtacgggggaactaacgggtacgttttaccaccgtcctaccgacctagtactacgtccacgtcgtacgtcgtacgtacgtagtaagttagttttgacgttacgtttagttactgtacagtactaagttaatacgttacgtacgtacggtccccgttacgtaccggttaccgttaaccggtttccgggacgggtaacgggtaaccggtaaaggggtaggtaacggtaacgtaaaccgtaaacggtaacggttggtaccggtagacggtacctacgttaccg

SEQ ID NO: 272158 - DNA, 656 bp, Homo sapiens
  misc_feature: GYAE6OF01BTE8G.17.49.E05.1.454.CMB.1.raw
  modified_base (206)..(206): a, c, t, g, unknown or other
  misc_feature (206)..(206): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcacgggccactcagagtacttaccagactaacgttagccttggtaccagcaagaacctggaccaggctcccaggctcctcgtatttagtggtcgctactccaccgagggccacgtggtactccacgccaggtccaggtggcaggtcgggtcgtgggacaggtacgttccacttcgtaccaaccgtataccgacgtacgtacgtcccgtcggtaactaccgttacgtaacggtaaacgtttagttttacggactttaacggtttttataacccgttaggtaccaaggtaactaaattaacgtaagtaccgtacgtccgtacccgtccgtacctccgtacgtttcggggacggtacgggaacccgaaggggttaggaacgtacgtaaccgtaaacggtaccgttacgggcggtaaacccgtcgtaccgtaccgtaacg

SEQ ID NO: 272159 - DNA, 631 bp, Homo sapiens
  misc_feature: GYAE6OF01E5A5U.17.49.E05.1.454.CMB.1.raw
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngcccaccctctcctgcagggccactcagagtataccagcaacttagcctggtaccagcaagaaacctggccaggctcccgaggcctcccgtctatttatggtcncactcccgaaccgagggccctaacgtggtaactcccgaggcctagggtttcaaggtgggactaggttcggggtcgtggggaactaggtacgtttcaacgttcctacaacctataccgacgcacgcctgactagtcgtagtaagttgttttacgcttaagttttatacgtgtacgagtactaagttaactaatcgtaccgttcggtcccttccggtacccttacgttaccggtttccggggaccgggtaacggaacccggtaagggtaggaacgtactaaccggaaacgtacgtcggtacggactcggtaccgacgttacgg

SEQ ID NO: 272160 - DNA, 578 bp, Homo sapiens
  misc_feature: GYAE6OF01ACSOK.17.49.E05.1.454.CMB.1.raw
  modified_base (204)..(204): a, c, t, g, unknown or other
  misc_feature (204)..(204): n is a, c, g, or t
  modified_base (480)..(480): a, c, t, g, unknown or other
  misc_feature (480)..(480): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccactcagagtattaccagcaacttagcctggtaccagcagaaacctggccaggcctcccgaggcctcctctatttagtggtgcactcccaccgcgggccctacgtcggtactccccgagccgtaggttcaggtcggcaggttcgggtcgtcggggacaggtacgttccacgttcctacaccagtcagcacgtcctgactagttcgtagtaagttgttttgacttagtttacttcgtcgtacagactaatataagtntacgtcgtcctcctctcgtacgttcgggacggacggtacgtagggtagaacgtctaaccgaaacggtacgtcggtacggtcgtcgacgtaccgttacg

SEQ ID NO: 272161 - DNA, 891 bp, Homo sapiens
  misc_feature: GYAE6OF01BBC1J.17.49.E05.1.454.CMB.1.raw
  modified_base (210)..(210): a, c, t, g, unknown or other
  misc_feature (210)..(210): n is a, c, g, or t
tcagcgtagactagcacgaccggtgctcgatttagagcgactagcaacacacaaagggggaggaactgctcagttaggacccagacggaaccatggaagccccagcgcagcttctcttcctcctgctactctggctcccagataccactggagaaatagtgatgacgcagtcctccacgcccaccctgtctgtgtctaccgaaggggaancgcccaccctctcctgcgacgggccactcaggtagtacttaccgagacctaacgttacgccgtacggtaacccagtaccgaaacggtaaacccgttcgggaccacggtcccttaccccgacggtccccttaccttacgtaattttacgtcgggtactaccgtacctacccgaccggtaccgggtacccctaacggttaccgggttaaccctaccccggaaccggtacccggtaacgggttaccgacggggttacgggacggttacggggttccggggtaccggttacggggtaaccgtaacgggtaaccggtttacctaccggttaccctacccggtaacctacgtaccgacggaccgtaacggtcccgtacgaccgtaacgtttacgtaacggttaaacgtttgttttacggtaaccttttagtttttaaccgttaccgttacgtaaccgtaacgttaactaaaacgtttaacttaacggttcggtaacccgtttcccggtaccccgttacccgttaccgttaacccggtttaccgggttaaccggggaccggggtaaaaccgggttaacccggggtaagggttaaccgggtaaacggttaaaccgtaacccgggtaaaaacggtcccgggttaagggtaccgtaacccggttacccggtaaccgtaacccggttaaccg

SEQ ID NO: 272162 - DNA, 649 bp, Homo sapiens
  misc_feature: GYAE6OF01BPM3B.17.49.E05.1.454.CMB.1.raw
  modified_base (204)..(204): a, c, t, g, unknown or other
  misc_feature (204)..(204): n is a, c, g, or t
  modified_base (313)..(313): a, c, t, g, unknown or other
  misc_feature (313)..(313): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcgagggccactcagagtacttaccagcaacttgcctggtaccagcaagaaccctggccaggcctacccgaggcctccctctatttacgtggtcncactcccaccgagggcccacgtcggtactccccgagtcccgtaggttccaggtcggctacgggtgggtcgtagggactaggtacgttccaaccttcctaccaaccatccgagtccacgtcccgttagacctagttcgtaggtaaacttgttttacgacctttagttttacgtacgtgttaccgaacgttactaaagtttaactaggttacgaaccgttcggccccttacgtcttccgttaccggtttccgggaaccgggtaccggtaacggtagggtacggtaacgtactaacccggaaaagttaccgttggtccggacttcgaccctacgttacg

SEQ ID NO: 272163 - DNA, 813 bp, Homo sapiens
  misc_feature: GYAE6OF01A8D5A.17.49.E05.1.454.CMB.1.raw
  modified_base (156)..(156): a, c, t, g, unknown or other
  misc_feature (156)..(156): n is a, c, g, or t
  modified_base (217)..(217): a, c, t, g, unknown or other
  misc_feature (217)..(217): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggcctacccagactaccactggaanaaatgtgatgacgctagtcctccacgcccaccctggtctgtcgtcctccggaagggaaacnccgcccacccgttctaccgcggccgacgggcccacgtccgaagtaacgttacttaaccgaacgtacctaacgttaccggtcccgtacgggtaaacccagaccgtaacggtaaaccgtccgggaccctacggtccccgtaccccggacggttccctacccgttattaaggttttccgtggtaccacgtacctaccccgaccggacggtaccctacgttacggtacccacccgtacgaccgtaggttacgagggtcgacggtacgggttcggtacggtacgggtacgtacggttcccgtaccttacccgtacgtaaccctacgtaacgtcgaccggtacgtacccgttccccgagtacccgtaaaaggttcctaaaggggttactttttacggttaccgtaagttttaaccgttttctaccggtgtaaccaacttaattactaagttcgccggtaccgttccgaccctcgttactaccgggttcccggtaggggaaaccggtaccgggtaagttacggggtacaacccgttaaaacggtaaaccggttacccgtaaggttcccgggactttaaccccggcttacccgtaacgtttccg

SEQ ID NO: 272164 - DNA, 889 bp, Homo sapiens
  misc_feature: GYAE6OF01CBQVE.17.49.E05.1.454.CMB.1.raw
  modified_base (209)..(209): a, c, t, g, unknown or other
  misc_feature (209)..(209): n is a, c, g, or t
tcagcgtagactagcacgaccggtgctcgatttagagcgactagcaacacgacaaaggggaggaactgctcagttaggacccagacggaaccatggaagccccagcgcagcttctcttcctcctgctactctggctccagataccactggagaaatgtgatggacgcagtctccagccacctgtctgtcgtcctaccggaggggtaacncgcccaccctctccgtgcgacgggcctactcgagtacgttaacttaccgacgtactaacgttacgacccgttacgggtaacccagggtaccctaaacggtaaaaccccggttgggacccgtaacgggccccgttaccccgaacgggtcccttacccgttaccgtttaaggttttacggtcgggtaccgtaccgaaccgttaccccggaaccgggtacgggtaccccgttacgggttaacgggttaaccgttacccccggaacggttacccggttaggggtttaacgacgggtacgggcgttaacgggggtcgggtcggtaacgggacgttaacggggtcctttaccaaccgttccgtaaccctaccggacgttacgaaccggtcgaccggttaccgcggtactacggtttaggaacggtttagtttaacgttttacgtaacgttttacggttttaattaccggtagtaaccggaagtaactaaacgtttaacgtaacgtcgtttaaccgggtccgttaaccccggttaccgttaccgttacggttaacccggggttttacggggacccggggtaaaacgggttacggggttaacgggtaaccgggtaagttaaacccgtaacggtaaaccggtcccgggttagggttacccggacgttcccggtaaatcccggttaccgg

SEQ ID NO: 272165 - DNA, 823 bp, Homo sapiens
  misc_feature: GYAE6OF01CSUTO.17.49.E05.1.454.CMB.1.raw
  modified_base (454)..(454): a, c, t, g, unknown or other
  misc_feature (454)..(454): n is a, c, g, or t
  modified_base (560)..(560): a, c, t, g, unknown or other
  misc_feature (560)..(560): n is a, c, g, or t
tcagcgtagactagcacgaccggtgctcgatttagagcgactagcaacacaacaaaggggaggaactgctcagttaggacccagacggaaccatggaacgcccagcgcagcttctcttcctcctgctactctggcctcccagactaccacgtggaagaaatagtgatgacgcacgtctaccacgccacccgtgttcttcggtgttccgtaccgaagggggaaacgacgcccctacccttcctccgtcgaccgaacgggccaacgtccgaaaggtacgttaacttacccgaacgtacctaacgttacgcccgtttacggaaaccagaccgaaacggtaaaccgtcggacccgaacggccccgtacccgacggcccttacccttaacgttacgtttaagtcgggtaccgacctaaccgtacccgtaaccggacggtaccctacggtacggttaccnccgtacgtccggtaacggttcgaggtcgggtacgtacggggttcggtacggtagggactagggtctacctaccgtctaccacgtagtacgcgacccgacgttccgngtactacggttagtaacggttacgtttacgttaacgttaccgtttaggttttaaccttacggtctaacgtataaacgttaaattaacggttacttacgggttacccgttccgtacccggttaaccgcgtttaacccggttacggtaccgggtaaaccggggtaacgggtaacccggtaaaggggtaccgtaaacgtaaacccggaaccggtaaacgttaaccgggtcggttaccgtaccggtacggaaccgttaccgttaacg

SEQ ID NO: 272166 - DNA, 502 bp, Homo sapiens
  misc_feature: GYAE6OF02IHDLM.17.49.E05.1.454.CMB.1.raw
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtactcccagccaggttcagtggcagtgggtctgggacagagttcactctcaccatcagcagcctgcagtctgaagtattttgctagtttattactgtcagcaatataatgactgcctccgctctacgtttcggcggagggaccgaaggtggagtatacgaaacgactggtcgctgcactac

SEQ ID NO: 272167 - DNA, 491 bp, Homo sapiens
  misc_feature: GYAE6OF02HJL1E.17.49.E05.1.454.CMB.1.raw
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtggtctgggacagagttcactctcaccatcagcagcctgcagtctgaagtattttgctagtttattactgtcagcaatataatgactggcctcgctcactttcgctgacgggacaaggtggaagatacaacgactgtggctgctac

SEQ ID NO: 272168 - DNA, 650 bp, Homo sapiens
  misc_feature: GYAE6OF02IW5AE.17.49.E05.1.454.CMB.1.raw
tcagcgtagactagcacgaccggtgctcgatttagagcgactagctaacgtacggacaaaggggaggaacctgctcagttaggacccagacggtaaccatggaagccccagcgcagcttactcttcctccgtgctaacctctgggcttcccgagagtaccacgttcggagaaattagttgtatggacgcagtctccagaccaccctgtctgtggtctccaggggaacagcccacccgtctcctcgcgagggccactccagtagtacttaccagctaacttagccttggtaaccagccacgaaacctggccacggcgtccccacggctccctacagtttactagggtcgcaagtccgtaaccggtacgggtaccctaaccgtgggttactaccctacgaccgtaaggtttcctaacggtaggtcgacgggtcgggttctgggacgaggtacgttcacgtctcactactccgagacagccctgacctagtctagaactatttcgcttagtttatactgtcagactaatactaatcgtactcgtccttacgtcttacgtaccgtttccgggacggtaacgggtacccgaagggttcggaacgggtacctaacgaaaccgggtaccgtacggtacggctacggtcctacctacg

SEQ ID NO: 272169 - DNA, 1155 bp, Homo sapiens
  misc_feature: GYAE6OF02F8AA6.17.49.E05.1.454.CMB.1.raw
tcagcgtagactagcacgaccggtgctcgatttagagcgactagctaacgtacggaccaaaaacgggaggaaccctcgtcgtcaagttaccggacccagaccggaaccatggaacgcccccaacgcgcgagcgttacctcgttcctccctgcctttacctcgtgggcctcccagataccaactgggagaaacctagtgactggtacgcagtcgtccagccaccctggtctcgtgtcgtccgaaggggaaagcgccgaccctctccgtgaccgtacgggcccacgtccaaggacgttactttaccgagtaccttaaacgttacgaccttaggtacccgtaagtccaaacggtaaaacccggttgggaccccgaacgggtaccgttaccccccccgtaagggggtaccccttaccccggttacccaagttttttaaggtacggggtttacgggacctaacgggttacccctaacccggtaacgggggtaccccaaccggttccggggttaacctttacccccgaaaggtaacccctaaacgggtttacccaaacggttaccggggtacctacgggttacggggtaccgttaacggggggtaaaccgttaacgggtaacggggtttacccaaaccggtttacccgttaccccgaaacccccgtaagttaccccgaaacgggtacccgtaaacggtacccccgtttaacggtacccccgtaaacgggtttacccgtaacgggtaaaacccggttaaccgtttttttacccgggaaacccgtttaacgggtttttttaacggtttaaacccgtttcgggtttaacccggtaaacgggttaacccgttaaaaccgtttaaggttaaaacggtttacggttaaacccggtttaccgggggtaacccccgtttaccccgggtaaccccggtttacccggttttaacccgggtttttttaccccgggggtaccgggggttaaacccggggggttaacccccgggtaaaacgggggggtttaaccggggttaaaccgggttaaaccggtttaaacccgggttaaaaaacccgggtttaaacccgggttttaacggggtttaacccggggggttaaccctttaaccgggggttacccccgggtaaacccccggtttaaacccgggg

SEQ ID NO: 272170 - DNA, 503 bp, Homo sapiens
  misc_feature: GYAE6OF02HBKTA.17.49.E05.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (394)..(394): a, c, t, g, unknown or other
  misc_feature (394)..(394): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccactcagagtattaccagcaacttagcctggtaccagcagaaacctggccaggctccaggctctcatttanggtncatccaccagggccactggtatcccagccaggttcagtgcaggtgggtctgggacagtagttcactctcacatcagcagcctgcagtctgaagtntttgctagtttattacgtgtacagtacaatataatgactggcctccgctctacgtttcggcgagggtaccaagggtgagatacgaaagtactggtggactgacactacg

SEQ ID NO: 272171 - DNA, 518 bp, Homo sapiens
  misc_feature: GYAE6OF02HC9QY.17.49.E05.1.454.CMB.1.raw
tcagcgtagactagcacgaccggtgctcgatttagagcgactagcaacacacaaaggggaggaactgctcagttaggacccagacggaaccatggaagccccacgcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctccctcatttatggtgcatcccaccagggcccactggtactccccagccaggttcagtggcagtgggtctgggacagagttcactctcacatcagcagcctgcagtctagaagtatttgactagtttattactgtcagtcaatatatgtactcgcctcgctccgtacttcggcggaggaccgtaagggtggagtaactacgaaacgacttggtacggtcctgaccactag

SEQ ID NO: 272172 - DNA, 627 bp, Homo sapiens
  misc_feature: GYAE6OF02JYNRA.17.49.E05.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccactcagagtataccagcaacttgcctggaccagcaagaacctggccaggctcccgaggctcctnatttancggtgacactcccacgacgggccagtggtactcccgagccctaggttcaggtcggactaggtcgggtcgtaggacagtcgttccactcctaccactagtccgagccgacgccgtgacgtacgttacgtaggtaaagttacttttacgtaccgttagtttttaacgttaccgttgttacctaaggtactaaattaataagtacgtacgtccggttaccttccgtacgtaccgttaccgtttccgggacggtacgggtaaccggtaagggttacggaagtaacgtaaccgtaaacgacgttacggtacggtaccgtacgtaccgaaccgtcg

SEQ ID NO: 272173 - DNA, 574 bp, Homo sapiens
  misc_feature: GYAE6OF02HJA3C.17.49.E05.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (356)..(356): a, c, t, g, unknown or other
  misc_feature (356)..(356): n is a, c, g, or t
  modified_base (404)..(404): a, c, t, g, unknown or other
  misc_feature (404)..(404): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccactcagagtattaccagcaacttagcctggtaccagcagaacctggccaggcctccaggctcctnatttatggtgcatccaccgagggcccagtggtactccccgagccaggttcagtggcaggtgggtcngggacagtagttcactctacacatcagcagcctgctagtctgtaagtntttcgcttagtttattacgtgtacagtactaattaattaacgtgtacgtcggtacccttccggacttccgtaccgtttccgggacggtacgggtaacccgtaagggtcggaacggtaacgtaaccgtaaacggtaccgtacgggtacggtcgtacggaccgtaccgtacg

SEQ ID NO: 272174 - DNA, 654 bp, Homo sapiens
  misc_feature: GYAE6OF02JLCT4.17.49.E05.1.454.CMB.1.raw
  modified_base (334)..(334): a, c, t, g, unknown or other
  misc_feature (334)..(334): n is a, c, g, or t
  modified_base (479)..(479): a, c, t, g, unknown or other
  misc_feature (479)..(479): n is a, c, g, or t
  modified_base (629)..(629): a, c, t, g, unknown or other
  misc_feature (629)..(629): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagactaccactggagaaatagtgatgacgcagtctccagccaccctgtctgtgtctccgaggggaaagacgccaaccctctcctgccgagggcccactcagagttactaccagcaacttagcctggtacccagacctaagaaaccctggaccaggtcctacccgaggccttaccctcctaattttagtcgggtacncaacttcccaaccgtagggcccaacgttcggtacctcccgtagcccgttaggttccagttcgggctacggttgggtctacgggggtacaacgggtagtttacccaccttccgtacccgaaccgtattcgacgaccgtacgtcccnggtaccgtacgtccgtagtaacgtacttttcgacgttagtttactttacgtcgttcagtacaagttacgtaattgtacgtcgtcctacgtctacacttagtcgggaccggaggtacgaacgggtggaacggtataaccggaaggttaccnggtaacggtccctaggacccgtaac

SEQ ID NO: 272175 - DNA, 525 bp, Homo sapiens
  misc_feature: GYAE6OF02FQLI3.17.49.E05.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcagaaacctggccaggctccaggctcctcatttanggtncatccacngggccatggtactcccagccaggttcagtggcagtgggtctgggacagagttcacttctcaccatcagcagcctgctagtctgaagtatttgctagtttattacgtgtcagtactaatattaatgtactcggtcctccgctcgtacgtttcgggacggagggaccgtaagggtaggagactacgaacgtacgtggtacggctcggacctacgtacg

SEQ ID NO: 272176 - DNA, 680 bp, Homo sapiens
  misc_feature: GYAE6OF02HZFHC.17.49.E05.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgccagggccactcagagtattaccagcaacttagcctaggtaccagcagaacctggccaggcctcccgaggtcctcctctattttacgtggtncactcccaccgagggccacgtggtactccccgagtcctaggttcagtcggacaggttgggtacgtgggaacaggtacgtttaccaccttctaccacccgattacgacgcgtacggtcctcgacgtacggtaccgtaggaacgttagttttcgacgtttagttttaacgtttaccgttacggtacctaaggtacttaaagtttaacttaaagttacggtaaccgttacggtaccccgttacccggtacctttaccgttaaccggttttaccgggaccgggtaacggggtaacccggtaaggggttacgggaagtaacgtaaccgtaaaacggtacgttagggttacggtaccgtcgacccgtaccgtacg

SEQ ID NO: 272177 - DNA, 631 bp, Homo sapiens
  misc_feature: GYAE6OF02JHY81.17.49.E05.1.454.CMB.1.raw
  modified_base (205)..(205): a, c, t, g, unknown or other
  misc_feature (205)..(205): n is a, c, g, or t
  modified_base (379)..(379): a, c, t, g, unknown or other
  misc_feature (379)..(379): n is a, c, g, or t
  modified_base (441)..(441): a, c, t, g, unknown or other
  misc_feature (441)..(441): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcacgggccactcagagtattaccagcaacttgcctggtaccagcagaacctggaccaggcctacccgaggccttccctctatttatcggtcgcactcccaaccgacgggtcccacgttggtactccccgagtcctaggttcaggtcggcaggttggtcngggtacagtacgttcactcgtacacgtatcgagcacgtccgtgacgtagttctaggaacttntttagcctttaagttttacgtcgtagtcgaagtactaaacgttataaacgtcgtaaccgttacggcccttaccgtcttaccgttacgggtttaccgggacgggtaacggtaacccgtaagggtacggaagtaaccgtaacgtaaaccgggttacggttggtacggtccgtacgtaccgtacccgtaacgg

SEQ ID NO: 272178 - DNA, 525 bp, Homo sapiens
  misc_feature: GYAE6OF02IE998.17.49.E05.1.454.CMB.1.raw
  modified_base (325)..(325): a, c, t, g, unknown or other
  misc_feature (325)..(325): n is a, c, g, or t
  modified_base (397)..(397): a, c, t, g, unknown or other
  misc_feature (397)..(397): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccacgtggtancccagccaggttcagtgcagtggtctgggacagtagttcactctcaccatcagcagcctgcagtctgaagtntttgctagtttattactgtacagactaatatatgtactcgtcctccgctcgtacgtttcggacggtacggaccgtaagggtaggagacgtacgaaacggtacgtaggtacggcgtacgaccacctacg

SEQ ID NO: 272179 - DNA, 694 bp, Homo sapiens
  misc_feature: GYAE6OF02IJUZS.17.49.E05.1.454.CMB.1.raw
  modified_base (205)..(205): a, c, t, g, unknown or other
  misc_feature (205)..(205): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcgagggccactcagacgtattaccagcaacttgcctggtaccagcaagaaacctggccaggcctcccgaggcctcctctagtttagtggtacgcactcccgaccgtacgggccctacgtggtacctcccgacgtccgtaggtttcaagggttgcgtaggttcgggtacgtgggactagacgttcaccgttctaccgacctatcgacgacctacgccgtgcgtagtacgtagtaacgttagttttagactttaacgtttttacttacttcgttaccgaagttaccttaaaagttaactttaactcgttaacccggttcggtaccccttacccggtccttaccgttaccggtttccgggggacggtaaccgggttaccggaaagggttcgggtaacggtaaaccgttaacggtaaaacccggttaacgttcggggttaaccggtacccgtaacggttaccccgtaaccgtttaacg

SEQ ID NO: 272180 - DNA, 661 bp, Homo sapiens
  misc_feature: GYAE6OF02JIJW8.17.49.E05.1.454.CMB.1.raw
  modified_base (250)..(250): a, c, t, g, unknown or other
  misc_feature (250)..(250): n is a, c, g, or t
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (534)..(534): a, c, t, g, unknown or other
  misc_feature (534)..(534): n is a, c, g, or t
  modified_base (553)..(553): a, c, t, g, unknown or other
  misc_feature (553)..(553): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggaagaaatagtgatgacgcagtctccagccaccctgtctgtgtcctccgaggggaagacggccaccctctcctgcgtacgggccactcagagtactacganactaacttagccgtacgtaccagtacgaacgaaaccgtcggaccacggccctacccgaggtccttccgtcgtaatttacgngggtcactactaccacgacggcctagtacgtacnccgacgccgtacggttccaggtcggacgtaggtcggtacgtacgggactagtaccgtactacgtctaccgaacttcgacgtacaccgagtccgtagcgtaacgtcgtaagggtatttattacgtactttaagtttactcgactttaccgagttaactaagtaacgttancgttacgtccgtaccgtcncttaccggttacggtcggtaccgggaaccggtacgggtaacgggttagaaacgtaccgtaaacgaaaccggttcggtaacggtcgaacgttccgacgtaccttacccg

SEQ ID NO: 272181 - DNA, 802 bp, Homo sapiens
  misc_feature: GYAE6OF02IIV0J.17.49.E05.1.454.CMB.1.raw
  modified_base (206)..(206): a, c, t, g, unknown or other
  misc_feature (206)..(206): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtcctccgagggaaagngcccaccctctcctgcgacgggccactcgaagtacgtacttaaccagacctaaacttacgccgtacggtaaccacgacaacgaaaacccgtcggaccgaacggcctaccccgacggccttccctactattttagtcggtacgactacgtacccgaccgaacgggcctaaccggtacggttaccgtaccccgacgtacccgtacggttcgacggtacgggccgagggttcgggtacggttacggggaacgtacggttaacgttacccgtaaccttccgtaaccgtaccctaacgtaccgacggtacccgacggtacccgtacgtaccggttaacggttccgttaaggtaacggttttacgtttttacggtacgttttaacggtttttaactttaccgttacgttacgtaacgtaaacttaaagtttaacttaaacgttacggtaaccttccgggttaaccccgttcgtacccgtttaccggttacccggtttaacggggaccggggtaacggtaaccgggtaaagggtacggaacggttaacgtaaccgtaaaaccggttggtaccggtaggccgttacggaccctaacgttaccgg

SEQ ID NO: 272182 - DNA, 728 bp, Homo sapiens
  misc_feature: GYAE6OF02ID86N.17.49.E05.1.454.CMB.1.raw
  modified_base (207)..(207): a, c, t, g, unknown or other
  misc_feature (207)..(207): n is a, c, g, or t
  modified_base (337)..(337): a, c, t, g, unknown or other
  misc_feature (337)..(337): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtcctccgaggggaaagngcccaccctcctcctgccgagggcccactcagagtacttaccagcaacttagcctaggtaccagcaacgaaacctggaccaggcctacccgaggccttcctctattttacgtggtgccactacccaccgngggcccacgtcggtactacccgaacgtccgtaacggttcgaggttcggcgtagggtcgggttcgtagggaactaaggtacgtttaccaccgttacctaccgaacctatcgaacgtccgaacgtccgtacgacgtagtcgttaaggaacgtttacgttttaggacctttaaggtttttaacctacttacggtcctaaagttactaaaagtttaacctaaggtacgttaccggttccgtacccccgttacggtccctttaaccgttaccgtttacgggggacccgggttaaacggggtaacccgtaaggggtaaccggttaggtaaccttaaaccgggtaaacggtaccggtttacgggtacgggttaccccaggtaccccctaccggttacg

SEQ ID NO: 272183 - DNA, 582 bp, Homo sapiens
  misc_feature: GYAE6OF02G5N6Z.17.49.E05.1.454.CMB.1.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcacgggccactcagagtattaccagcaacttagcctggtaccagcagaaacctggccaggctcccgagcctcctnattanggtnctactccacagggccactggtactccagcctaggttcagtggcaggtgggtcgtggacagtacgttcacttcnccacagtccagcacggtcctcgcgtagtctagtaagttntttagtcttagtttacttacgtgtactacgtactaattagtaacttcgacttcggccgttccgtactaccgttacgtttccgggagggtaccgggtaccgtaagggtcggtaacgtaacgtaacggtaaacgtagtaccgggtagtaccgtacggtacctacgtacg

SEQ ID NO: 272184 - DNA, 668 bp, Homo sapiens
  misc_feature: GYAE6OF02GW7SF.17.49.E05.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccactcagagtataccagcaacttagcctggtaccagcagaaacctggccaggcctccaggcctcctctatttagtggtncactccaccgacgggccacgtggtactcccgacgccgaggttcaggtcggacgaggtgggtctgggactaggtacgttcacgtcctacacctatcgacgcgacgtccgtgacgtacgtcgtaggtaacgttacgttttacggaccgtttaagtttttacgttaccgttacggttacctaacggtacttaaagttaagttaacgttacggtaaccgttacggttccccttaccgtcctttaccgtaccggtttaccggggaccgggtaacgggtaacccggtaaggggttacggtaaacggtaccgttaaccggtaaaccgtacggttagggtaccggtacggtaccgtacccgtacgttaccg

SEQ ID NO: 272185 - DNA, 612 bp, Homo sapiens
  misc_feature: GYAE6OF02HWRE2.17.49.E05.1.454.CMB.1.raw
  modified_base (207)..(207): a, c, t, g, unknown or other
  misc_feature (207)..(207): n is a, c, g, or t
  modified_base (326)..(326): a, c, t, g, unknown or other
  misc_feature (326)..(326): n is a, c, g, or t
tcagcgtagactagcacgaccggtgctcgatttagagcgactagcaacacacaaaggggaggaactgctcagttaggacccagacggaaccatggaagccccagcgcagcttctcttcctcctgctactctggctcccagataccactggagaaatagtgatgacgcagtctccagccaccctgtctgtgtcctccgagggggaaanacgacccacccttctccgtgccgagggccactcagagttattaccagctaacttacgcctaggtaccagccaagaaacctggaccaggcctcccgaggcctcctactatttagtcggtnactactccaccgaggccacgttggtactaccccaggcctacggttacacggtgcgtaggtcgggtacgtgggacaggtacttcactccgtacacctatcgacgtacacgtcctgctagtcgagttaacgtatttcgactttagttttaactacttgtacaagtactaattaataagtcgtacgtccgtcccgtccgtcttccgtacgttcgggacggtacggtaccgtaagggtcgtaagtacgtaacggaaaccgtgtagggtccgtacgtacgacctacgtacg

SEQ ID NO: 272186 - DNA, 895 bp, Homo sapiens
  misc_feature: GYAE6OF02JB2EK.17.49.E05.1.454.CMB.1.raw
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
tcagcgtagactagcacgaccggtgctcgatttagagcgactagcaacacacgaaaggggaggaactgctcagttaggacccagacgggaaccatggaagccccagcgcagcttctcttcctcctgctactctggtcctcccagactaccacgtggaagaaatagtgatgacgtcagtcctccacgcctacccgttgttcctggtacgtccgtacggaaggggaaacgaccgcccaccccttctccgtcggcgacgggacccacgtacgagtagtacttaccgacgactaactcgccgtaggtaccngccgaagtaaccgtcggccaccgggtcctacccgacggtcctacctcttagttttacgcgggtanaccgtacncccggaaccggacggtacccacgtttcggtacctcccgtacggtcctacggttccgaggtcgtacgtgggttaccggggtacgtacgggacgtacgttaccgtttcccaaccggttctaacccgaaccgtcgtacccgtacgtaccggtacggtacccgtacggtaccgtacggttacgttaacgggtaacgttttacgtttaacggttaccgttttaaaccggttttaacggtttaacccgtttaacggttaccgtaaacgttaaccgttaaagttaaacgtttaaccggtttacgggttaacccggttcccgggtttaacccgtttcccggttaaccgttaccgggtttaacccgggttccgggggtaacccgggggtaaccgggttaaaccggggttaaacggggttaacccggtaaaggggttaaccccgtaaacgggttaaaaccccgggtttacgggtacccggggttacggttacccggtacccggttaccctaaccggtttaacccg

SEQ ID NO: 272187 - DNA, 818 bp, Homo sapiens
  misc_feature: GYAE6OF02GCA3Z.17.49.E05.1.454.CMB.1.raw
tcagcgtagactagcacgaccggtgctcgatttagagcgactagcaacgacacaaaggggaggaactgctcacgttaggaccccagacggaacccatggtaagcccctagcgcagcttctcttcctacctgctactctgcctccagacttaccgacgtaggaagtaaagttaggttcgtagttggtacgtacgagttcctaccacgtccctacccgtggttctgtacgtcctaccggaaggggaagcgcccgtaccttctccgtcgacgacggccacgtccagtagttaccttaccacgtactaacgttcgaccgtcggtaccagaccaacgtaacccgtcgtaccgacggtacccgtaccccgaacggtacccttacccgttacgttaacgtttttacggtccgggtaccgacctaccgttaccccgaaccggggtaacgggtacccctaggttacgggttacctaccccgacgtaccgttacggttacgagggtcgacgtaggttcgggtacgtagggaactacgtacgttccacgttcctacccgaaccgtaagtaccgacgaccgtacgtcccgtacgacgtacggtacgtaaggttaacgttacgttttacggaacttttaacgttttaccttaacgttcgttactaacgttaacttaaattaacgttaacgtacgtaacccgttaccggtacccttacccggtaccttaccgggttaccgttacgggaccggttaacggacggtaaggggtaacgaaccggtaattaaccggaagttacgttcgggtacgtactaccggacctaccgtacgg

SEQ ID NO: 272188 - DNA, 169 bp, Homo sapiens
  misc_feature: GYAE6OF01BCX1O.14.25.C03.1.454.CMB.1.raw
  modified_base (168)..(169): a, c, t, g, unknown or other
  misc_feature (168)..(169): n is a, c, g, or t
tcagcgtctagtaccacgaccggtgctcgatttagtagtgtagatttgggttgggaagaggaatactgacggtcccaggagttcaggtgctgggcacagcggccctgggctgcctggtcaaggactacttccgtactagacgctgagcgggctggcaaggcgcatagnn

SEQ ID NO: 272189 - DNA, 427 bp, Homo sapiens
  misc_feature: GYAE6OF01CD220.14.25.C03.1.454.CMB.1.raw
  modified_base (422)..(427): a, c, t, g, unknown or other
  misc_feature (422)..(427): n is a, c, g, or t
tcagcgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttccccctggcaccctcctccaagagcacctctgggggcacagcggccctgggctgcctggtcaaggctacttccgtactagacgctgagcgggctggcaaggcgcatagnnnnnn

SEQ ID NO: 272190 - DNA, 511 bp, Homo sapiens
  misc_feature: GYAE6OF01D68JJ.14.25.C03.1.454.CMB.1.raw
  modified_base (486)..(486): a, c, t, g, unknown or other
  misc_feature (486)..(486): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagcgtggttttcgtcgttaggctctttaagaggtgtccagtgtcaggtgcagctggtggagtctgggggaggcgtggtccagcctgggaggtccctgagactctcctgtgcagcctctggattcaccttcagtacctatgctatgcatgggtccgccaggctccgaggcgaggggctgggagtgggtggcgattatatcacatgatggaactaatagacgctatgccgactccgtgaagggccgattcaccatctccagagacaattccaagaacacgcagtatctgcaaatgaacagcctgagagctgaggacacggctgtaggtattacgtggtgggagngaagtgggaggtgattagtggtagg

SEQ ID NO: 272191 - DNA, 527 bp, Homo sapiens
  misc_feature: GYAE6OF01BMEMB.14.25.C03.1.454.CMB.1.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
  modified_base (457)..(457): a, c, t, g, unknown or other
  misc_feature (457)..(457): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcctctggattcaccttnagtacctatgctatgcacgtgggtccnccaggctccgaggcgagggctgggngtgggtgcgtattatatcacatgatggaactaangacgctaagtgccgactccggtagaacgggccattccacatctcagagacaatcaagaacacgcaagtatctagacaaatgaacagacctagaagngactaggaggacacggcttggtgtattacgtggtagggagaggagtgggaggtagaattgttggtaaggg

SEQ ID NO: 272192 - DNA, 527 bp, Homo sapiens
  misc_feature: GYAE6OF01CVX3P.14.25.C03.1.454.CMB.1.raw
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggttttccgtcgttaggctcttttaagaggtgtccagtgtcaggtgcagctggtggagtctgggggaggcgtggtccagcctggggaggtccctgagactctcctgtgcagcctctggattcaccttcagtacctatgctatgcactggggtccgccaggctccgagggcgagggggctgggagtgggtggcgattanatcacatgatggaaactaatagacgctancgccgactccgtgaacgggccgattcaccatcctcagagacaattccaagaacacgcagtatctagacaaatgaacacgctgagagctgaggacacggctggtgttattagtggtcgggagagtagtgggaggtgaagttgttggtaggg

SEQ ID NO: 272193 - DNA, 524 bp, Homo sapiens
  misc_feature: GYAE6OF01DT35I.14.25.C03.1.454.CMB.1.raw
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (488)..(488): a, c, t, g, unknown or other
  misc_feature (488)..(488): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtacctatgctatgcactgggtccnccaggctccaggcgaggggctggagtgggtgcgattanatcanatggatggaaactaatagacgctancgccgactccgtagaagggccattcacatctccagagacaattccaaagaacacgtcaagtatctagacaaatgaaacagcctagaagagctaggaaggacacgggctgtgtattacgnggtggggagagatgggacggtgaatagttggtaagg

SEQ ID NO: 272194 - DNA, 431 bp, Homo sapiens
  misc_feature: GYAE6OF01BL3M0.14.25.C03.1.454.CMB.1.raw
  modified_base (420)..(420): a, c, t, g, unknown or other
  misc_feature (420)..(420): n is a, c, g, or t
  modified_base (425)..(431): a, c, t, g, unknown or other
  misc_feature (425)..(431): n is a, c, g, or t
tcagcgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttccccctggcaccctcctccaagagcacctctgggggcacagcggccctgggctgcctggtcaaggactacttccgtactagacgctgagcgggctggcaaggcgnatagnnnnnnn

SEQ ID NO: 272195 - DNA, 555 bp, Homo sapiens
  misc_feature: GYAE6OF01DDDQV.14.25.C03.1.454.CMB.1.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagactctcctgtgcagcctctggattcaccttcagtacctatgctatgcacgtggggtccnccaggcctccgagggccgaggggctgggagtggggtggcgattanatcanatgatggaactatagacgctagtcgccgactccgtaggaacgggccgattccacctatcctccgagacgaactaacttaccaagaacacgacagtatctgacaaatgaacacgcctagacgagcgtagaacggaccgacggccgttgtaggttacttacgtggtagggagtaggagtgggaggtacgaagttgttggttaggg

SEQ ID NO: 272196 - DNA, 520 bp, Homo sapiens
  misc_feature: GYAE6OF01D7E2V.14.25.C03.1.454.CMB.1.raw
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccgaggcgaggggctgggagtgggtggcgattatatcacatgatggaactaatagacgctatcgccgactccggtagaacgggccgattccacctatcctccaagagaacaattcccaagaacacgcagtatctagcaaatgaacagcctagagagctgaggacacggctgtagtattagtggtgggagaggagtggaggtcgatgttggtagg

SEQ ID NO: 272197 - DNA, 634 bp, Homo sapiens
  misc_feature: GYAE6OF01ATAAV.14.25.C03.1.454.CMB.1.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagactctcctgtgcagcctctggattccaccttcagtacctatgctatgccacgtgggtcccncgaggcctccgaggcgaggggctgggagtgggtgcgtattanatcanatgatggaaactaagtacgacgctaagtcgacccgtactcccggtaggaacgggcccgtattccgaaccctatccctaccgaaggaacgaacctaacttacccgaaagtaaccacgactaagtactcgtacgactaaagtcgaaaccgacggtaccctaggaacgtacgaccgtaggacggaaccgaccgggtccttaggtaggttaacgttacggtagggttaggggaacgtaaggtacggttacggggtaacgggttacgtaagtttagttgggttaacggg

SEQ ID NO: 272198 - DNA, 596 bp, Homo sapiens
  misc_feature: GYAE6OF01CKYUD.14.25.C03.1.454.CMB.1.raw
tcagcgtctagtaccacgaccggtgctcgatttagtagtgtagatttgggtttggggagacgagcccagcactggaagtcgccggttgtttccattcggtgatcagcactgaacacagagactcaccatggagtttgggctgagcttgggttttcctcgttgcttcttttaagaggtgtccagtgtcaggtgcagctggtggagtcgtgggggaggcgtggtccagcctggggacgtccctgagactctcctgtgcagcctctggattccaccttcagtacctatgctatgctacgtgggtcccgccaggcctccgagggcggaggggctgggaggtggggtggcgtattatactcacatgagtaggaaactaagtaggacgacttagtcgaccgtacgttccggtaggaacgggcccgtattccgaacctacttcctaccgaagaacgaactaaacttacccaaagaaccacgacagttactcgtagactaaatcgaaacacgacctagagagcgtaggaaggaccgacgggtctggtagttagttacgtgggtgggagtaggagtagggtaggtacgaagttgttgggttaggg

SEQ ID NO: 272199 - DNA, 531 bp, Homo sapiens
  misc_feature: GYAE6OF01E3AKN.14.25.C03.1.454.CMB.1.raw
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtcccgcaggctcgaggcgaggggctgggagtgggtggcgattanatcacatgatggaactaatagacnctatcgccgactccgtgaacgggccgattcaccatcctccagagacaattaccaagaacacgcagtactctagactaaatgaacacgcctaggaacgagtctaggaacggacacggctggtgtattacgtggtgggagaggagtgggaggtagattagttggtagg

SEQ ID NO: 272200 - DNA, 522 bp, Homo sapiens
  misc_feature: GYAE6OF01AWEF5.14.25.C03.1.454.CMB.1.raw
  modified_base (301)..(301): a, c, t, g, unknown or other
  misc_feature (301)..(301): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtccncaggctccaggcgaggggctggagtgggtggcgtattatatcacatgatggaactaatagacgctagtcgccgactccggtggaacgggcccgtattccaccatctccagagacaattccaagaacacgcagtatctgacaaatgaacagcctgagagctaggaggacacggctgtgtattacgtggtgggagagagtgggaggtagattagttggttagg

SEQ ID NO: 272201 - DNA, 507 bp, Homo sapiens
  misc_feature: GYAE6OF01EFETD.14.25.C03.1.454.CMB.1.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggagtccctgagactctcctgtgcagcctctggattcaccttcagtacctatgctatgcactgggtcccncaggctccgaggcgaggggctgggagtgggtgcgattanatcacatgatggaactatagatgctatgccgactccgtgaacgggccgattcaccatcctcagagacaatccaagacacgcagtatctagacaaatcgaacacgcctagagagctgacggacacggctagtgtattacgtggtaggagaggtatgggagtcgatgttgg

SEQ ID NO: 272202 - DNA, 506 bp, Homo sapiens
  misc_feature: GYAE6OF01A5VS2.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgatcaccatctccagagacaattccaagaacacgacagtatctgacaaatgaacagcctagagagctgagacaggctgtgtattacgtggtgggagagagtggaggtgatgttgtaggg

SEQ ID NO: 272203 - DNA, 763 bp, Homo sapiens
  misc_feature: GYAE6OF01DPW6O.14.25.C03.1.454.CMB.1.raw
  modified_base (302)..(302): a, c, t, g, unknown or other
  misc_feature (302)..(302): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcacgtgggtcccnccgaggcctccgaggcggaggggctgggagtgggtgcgtattatatcaacagttgaataggaaacttaagtagaccgtctaagtcggacccgtaacgttcccggtagggaaacggggtcccgtaacgtttcccaacccgtaacttcccgttaacccgaaacggtaaaccgtaacctaaaacgttttaccccgaaaaacggtaaaaccccaaccggacccgtaacggtttaacttacccgttaaggtaaaccctaaaaagttaccggaaaacccgacggtaccccgttaggaaacggtacggtaccgtacgggaacgggtaacccgtaaccggggtaccgtttacgggttacggtttaaacgtttaaccgggttacggggttacgggggtaagggtaaggtaacgggttaagggggtaacgggtttaaccggtaaggttttaaggtttagggtttaaggggg

SEQ ID NO: 272204 - DNA, 513 bp, Homo sapiens
  misc_feature: GYAE6OF01E35N0.14.25.C03.1.454.CMB.1.raw
  modified_base (505)..(505): a, c, t, g, unknown or other
  misc_feature (505)..(505): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtccgccaggctccaggcgaggggctggagtgggtggcgattatatcacatgatggaaactaatagacgctatcgccgactccgtgaagggccgatcaccatctccagagacaattaccaacaacatgttagtatctgcaaatgaatagcctgagacgccggaggacacggctgtgtattactgtgtcagagagtgggaggggtggtgngtcgtagg

SEQ ID NO: 272205 - DNA, 627 bp, Homo sapiens
  misc_feature: GYAE6OF01DMW5L.14.25.C03.1.454.CMB.1.raw
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
  modified_base (509)..(509): a, c, t, g, unknown or other
  misc_feature (509)..(509): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtggggggaggcgtggtccagcctggggacggtccctgagactctcctgtgcagcctctggattccaccttcagttacctatgctatgcacgtgggtcccncaggcctccgaggcggaggggctgggagtggggtgcgtattanatcacattggattaggaaacttaagtacggactctagtcgacccgacgttccggtaggaacgggccgtacttccaacctactcctaccaaggaacgtaacaacttaaccaaacgaaccgaacgacaagttaactactacgaactaaagtcgaaaccncgtaccgtaggaacgaacgtacgtagggaacggaacgacggtccttaggtacgttaacgttacgtgggtagggaaggtaaggaggtagggaggttaggtaagttagttgggttagggg

SEQ ID NO: 272206 - DNA, 842 bp, Homo sapiens
  misc_feature: GYAE6OF01CD50G.14.25.C03.1.454.CMB.1.raw
  modified_base (302)..(302): a, c, t, g, unknown or other
  misc_feature (302)..(302): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcctctggattcaccttcagtacctatgctatgcactgggtccncaggcctccgaggcgaggggctgggagtgggtggcgtattatatcaactagtgaattagggaaaaccttaaagtacggaccgtacttaagtcgggaccccgtaacgttccccgggtagggaaaccgggggtccccgtaacgtttacccaaccccgtaacgttcccgttacccgaaacggaaaccggtaaaccctaaaaccgttttaaccccgaaaaacggtaaaacccgaaacccggtaacccgtaaacggtttaacgttaacccgttaacgggtaaaccctaaaaaacgtttacggaaaaacccgtaacgggtaacccccgttaagggaaaccgggtaacggtacccggttaacggggaaaccggggtaaacccggtaaacccgggggttaccgtttaacggggtttaacgggttttaaaccggttttaaccgggttagggggttaaggggggtaaagggtaaagggtaacgggtttaagggggtaaacggggtttaacgggtaaacggttttaagggttttaggggtttaaagggggg

SEQ ID NO: 272207 - DNA, 519 bp, Homo sapiens
  misc_feature: GYAE6OF01DV6SQ.14.25.C03.1.454.CMB.1.raw
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggttttccgcgttagctctttaagaggtgtccagtgtcaggtgcagctggtggagtctggggggaggcgtggtccagcctggggaggtccctgagactctcctgtgcagcctctggattcaccttcagtacctatgctatgcactgggtccncaggctccgaggcgaggggctgggagtgggtggcgattanatcacatgatggaactaatagacgctatcgccgactccggtgaacgggccgtattcaccatctccagagacaatccaagacacgcagtatctgacaatgaacagcctgagagcgtagacggacacggctgtagtattagtggtgggagaggtagtgggaggtagattgttggtaggg

SEQ ID NO: 272208 - DNA, 432 bp, Homo sapiens
  misc_feature: GYAE6OF01BC5O3.14.25.C03.1.454.CMB.1.raw
  modified_base (426)..(432): a, c, t, g, unknown or other
  misc_feature (426)..(432): n is a, c, g, or t
tcagcgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctggcaccctcctccaagacgcacctctgggggcacgagcggccctgggctgcctggtcaaggactacttccgtactagacgctgagcgggctggcaaggcgcatagnnnnnnn

SEQ ID NO: 272209 - DNA, 739 bp, Homo sapiens
  misc_feature: GYAE6OF01ERBM0.14.25.C03.1.454.CMB.1.raw
  modified_base (278)..(278): a, c, t, g, unknown or other
  misc_feature (278)..(278): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagcctggggagtccctggagactctcctgtgcagcctctggattcaccttnagtacctagtgctatggcctacgtcgggtcccgcagggcctccgaggcggaggggctgggagtgggtgcgtattanagtcacatgatggaaactaatacgacgntaagtcgaccgtacgtccggtaggaacgggtccgtaacgttcccaaccgtaactccgttacccgaagtaacggaacctaaactttacccgaaaagaacccaaccgactaaacgtacttaccgtaacggaacctaaaagttacgaaaccgtaaccggacccgttaagggaacggaacggtacccggtaagggaaaccggggtaaacccggtaaccggggtaccggttaagggtttacgggtttaaacggttttaccggttagggggttaagggggaaaggtaaacggggttaagggttacgggggttaacggggtttaaccgggtaaaggtttaaggttttagggggttaaacggggg

SEQ ID NO: 272210 - DNA, 609 bp, Homo sapiens
  misc_feature: GYAE6OF01CMHYS.14.25.C03.1.454.CMB.1.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtacctatgctatgcacgtgggtcccncaggctccgaggcgaggggctggaggtgggtgcgtattanatcacatgataggaaactaagtagacgtctaagtcgacccgacgttcccggtaggaacgggcccgtaagttcccaccgtactcctacccgaagaacgtaactaaactttacccgaaacgtaaaccaaccgacctaagttactacgttacgaacctaaagtacgaacacgacccgtagacgagcgtagaacggacgacggtctaggtagttacgttacgtagggtagggagtaaggtacgtagggtaggttagagttaggttggttaggg

SEQ ID NO: 272211 - DNA, 602 bp, Homo sapiens
  misc_feature: GYAE6OF01DVUDM.14.25.C03.1.454.CMB.1.raw
  modified_base (263)..(263): a, c, t, g, unknown or other
  misc_feature (263)..(263): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggtttcgcgttaggctctttaagagggtgtccagtgtcaggtgcagctggtggagtcgtgggggaggcgtggtccagccgtggggagtccctgagactctcctgtgcagcctntggattccaccttcagtacctatgctatcgcacgttgggcccnccaggctccgagggcgaggggctgggagtgggtgcgattatancacntgataggaaactatagacnttagngacccgactcggtagaacggtccgattaccacacttcaccaagacgtaacaagttccaagacgacgacaagtactctagactaaagtcgaaacgacgtacctaggacggtaagtccgaggaaccggtaaccgaggtccgttagttaggtttaacgttacggttagggtggggaaggtacgggtaaggttgggaacggttaggtagttaacggtttgggtaagggg

SEQ ID NO: 272212 - DNA, 608 bp, Homo sapiens
  misc_feature: GYAE6OF01APNFZ.14.25.C03.1.454.CMB.1.raw
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctggggagcgtggtccagcctgggaggtccctgagactctcctgtgcagcctntggattcaccttcagtacctatgctatgcacgtgggtccnccgaggcctccgaggcggaggggctgggagtgggtggcgattagtatcacagtgaagtggaactaagtagacgctatcgccgactccggtgaacgggccgattcgacctatcctccagaacgaactaacttaccaagaacaccgacagtactcgtcgacaaagtcgaaaccgacgtcccgtaaggacgaacgtcgtacgggaacgggtaaccacgggtcgttaggtaacggttacgtttacggtagggttacgggaaggtaaggtacgtaggggtaacggttacggtaagttagtttagggttaacgggg

SEQ ID NO: 272213 - DNA, 686 bp, Homo sapiens
  misc_feature: GYAE6OF01EXZ1Q.14.25.C03.1.454.CMB.1.raw
  modified_base (309)..(309): a, c, t, g, unknown or other
  misc_feature (309)..(309): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtggggacgtccctgagactctcctgtgcagcctctggattccaccttcacgtacctatgctatgcacgtcggggtcccnccgaggcctccgagggcggaggggctgggaggtgggtggcgtattagatcaactagtgagtaggaaactaagtacgacgtctagtcggacccgtacgtccggtaggaacgggtcccgtattacccaacctatcctaccgaagtaacgaaacctaacgttacccgaaacggtaaccaaccggtactaacgttactactacgaacaaacgttacgaaaccgtacggaccgtaggaacggacgtaccggtacgggaacgggtaaccgacgggttaccgttacgggttaacgtttacgtttaacgggttcggggtaggggaaggtaacgggtaggttacggggtaacggttacgtaaggtttaggtttaggggttaagggg

SEQ ID NO: 272214 - DNA, 594 bp, Homo sapiens
  misc_feature: GYAE6OF01ASMAB.14.25.C03.1.454.CMB.1.raw
  modified_base (374)..(374): a, c, t, g, unknown or other
  misc_feature (374)..(374): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcctctggattccaccttcagtacctatgctatgcacgtgggtcccgccaggcctccgaggcggaggggctgggagtggggtggcgattatatcacatgatggaaactaatagacnctatcgcccgactccggtaggaacgggcccgtattccaacctatcctacccaaggaacgaactaaacttacccgaaagaaacccacgaccaaggttactctagacctaaagtacgaaacacggcctaggagacgtcgtaggaacggacgacggtctaggtagttacttacgtgggtgggaacgaggtagtaggggaggtacgtaagttagtttggtaggg

SEQ ID NO: 272215 - DNA, 704 bp, Homo sapiens
  misc_feature: GYAE6OF01C4EKN.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagctgggtggagtcgtggggggagcgtggtccaggccgtggggagtccctgagactctcctgtgcagcctcgtgacttcaccttcacgttacctatcgactatcgccaccggtcgggtcccgaccgaggtccctaccgaaggggccggaaggggtctggggaggttggggtcggacggtaattagtactcgaactaagttggaaagttacggaaaacttaagtacggaccgtactaagtcgacccgttacgtacccggtaaggaacgggtccctaagttacccaacctacgtcctaacccgaaggtaacgtaactaaaccttaacgaaacgaaccgacgacgtaattacctaacgtagaaccgaaagtaacgaacacgaccgtaggaagacggtcctagggaacggaccgtacggtccttagggttacgttaacgtttacggtaggggtaacgggtaggtaaggtacggttaggggtaacggttaggttaattagggtttggtagggg

SEQ ID NO: 272216 - DNA, 536 bp, Homo sapiens
  misc_feature: GYAE6OF01BPS2A.14.25.C03.1.454.CMB.1.raw
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
tcagcgtctagtaccacgaccggtgctcgatttagtagtgtagatttgggtttggggggagacgagcccagcactggaagtcgccagtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggagtccctgagactctcctgtgcagcctctggattcaccttcagtacctatgctatgcactgggtccnccaggctccgaggcgaggggctgggagtgggtggcgattanatcacatgatggaactaagtagacgctatcgccgactccgtagaacgggccgattcaccatctccagacgacaacttaccaagaacacgacagtactctagacaaatagaacagtcccgtagacgagcgtggaggaccgacgggtctaggtgttattacgtggtagggagagtagtaggaggttcgagttgttaggg

SEQ ID NO: 272217 - DNA, 524 bp, Homo sapiens
  misc_feature: GYAE6OF01EUCRC.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgcaggctccgaggcgaggggctgggagtgggtggcgattatatcacatgatggaactaatagacgctatcgccgactccgtgaacgggccgattcaccatctccagacgacaattaccaagaaccacgacagtatctagacaaatgaacagcctagagacgcgtagaggacacggctaggtgttacttagtggtgggagagagtgggaggtagattgtggtaggg

SEQ ID NO: 272218 - DNA, 665 bp, Homo sapiens
  misc_feature: GYAE6OF01D8LMP.14.25.C03.1.454.CMB.1.raw
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagactctctgtgcagcctgtggacttcaccttnagtacctatgctancgcacgtcgggtcccnccgaggcctaccgaggcggaggggctgggagtggggtgacgtattagtancanatagataggaactaagacgacgtctagtcggacccgtaacgttcccgggtaggaaccggggtcccgtaacgtttacccgaacccgtacgttacccgttaccgaaggaacgtaaacccgttaaacttaacccgaaaacggaaaccctaaccggactaacggttaacttaccgtaacggaacctaaacgtacgaaacgacgtaccgtaggaacgacgacgtacggacggaaccgtacgggtcttaggttagttacgttaggtggtacgggagaggtagtagggtacggtagttagttagtggttaggg

SEQ ID NO: 272219 - DNA, 175 bp, Homo sapiens
  misc_feature: GYAE6OF01B88H8.14.25.C03.1.454.CMB.1.raw
  modified_base (173)..(175): a, c, t, g, unknown or other
  misc_feature (173)..(175): n is a, c, g, or t
tcagcgtctagtaccacgaccggtgctcgatttagtagtgtagatttgggtttgggggaagaggaagactgacggtcccccaggagttcaggtgctgggcacagcggccctgggctgcctggtcaaggactacttccgtactagacgctgagcgggctggcaaggcgcatagnnn

SEQ ID NO: 272220 - DNA, 668 bp, Homo sapiens
  misc_feature: GYAE6OF01DSPGP.14.25.C03.1.454.CMB.1.raw
  modified_base (315)..(315): a, c, t, g, unknown or other
  misc_feature (315)..(315): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagcgtgggtggagtcgtggggggaggcgtggtccagccgtggggacgtccctgagactctcctgtgcagtcctctggtattccaccttcagtacctatgctatcgctacgtgggtcccnccgacggcctccggaggcggacggggtctgggagggttggggtggacgtattaatagtacaacgtagttgaaagttagggaaaacttaagtacggacgtctaagtcgacccgtacgtccggtaaggacgggccgtactccgacctactcctaccgagaacgaactaacttaccgaaagtaaccgacgacgtacgtactacgtacgtactaaacgtgaaacgacgtaccgtaggacgacgacgtacggaacggacggaccggttcgtaggttacggttaacgttaggtagggttaggggacggtaaggtacgggttagggtacgggttacggtaagttagggttaggttagggg

SEQ ID NO: 272221 - DNA, 546 bp, Homo sapiens
  misc_feature: GYAE6OF01B16J8.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctagtggagtctgggggaggcgtggtccagcctgggaggtccctgagactctcctgtgcagcctctggattcaccttcagtacctatgctatgcacgtgggtcccgccaggcctccgaggcggaggggctgggagtgggtggcgattatatcacatgatggaactaagtagacgctatcgcccgtactcccggtaggaacgggccgtattccaccatcctccagacgacaacttaccaagaacacgcagtatctgacaatcgaacagccgtagagagcgtaggacggacgacggtctggtagtagttacgtgggtgggagaggagtgggtaggtagattagttggtaggg

SEQ ID NO: 272222 - DNA, 587 bp, Homo sapiens
  misc_feature: GYAE6OF01BUVZ2.14.25.C03.1.454.CMB.1.raw
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagcctggggacgtccctgagactctcctgtgcagcctctggattcacctttcagtacctatgctatgcacgtcgggtcccgccaggcctccgagggcggaggggctgggaggtgggtgcgtattatatcacatgatggaactaagtagacgtctatcgccgtactcccggtaggaacggccgtattccacctactcctacgagaacgaacaacttacccaagaacacgacagtactcgtacgacaacgtacgaacacgaccgtagacgagacgtaggaacggaccgacgggtcttaggttacgttagtttacgtagggtgggagtaaggtaggtagggaacggttgtaagttgttgggttaggg

SEQ ID NO: 272223 - DNA, 646 bp, Homo sapiens
  misc_feature: GYAE6OF01BS0Z6.14.25.C03.1.454.CMB.1.raw
  modified_base (300)..(300): a, c, t, g, unknown or other
  misc_feature (300)..(300): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgctacgtgggtcccncaggcctccgaggcggaggggctgggagtggggtggcgtattatatcacagtgatggaaactaatagacgctaatcggacccgtactcccggtaggaacgggtcccgtattaccgacctactcctaccgaagaacgaactaaacgttacccaaacgaaaccgtaaccgactaacgtacttacctacgaactaaacgtacgaaaccgtacgacccgtaggaaggacggacgtaggaacgggaaccgacggtacctagggttacgttaacgtttacggttgggttacgggggagtaagggtaggtaggggtaacgggttacgttaaggttaaggtttgggttaagggg

SEQ ID NO: 272224 - DNA, 550 bp, Homo sapiens
  misc_feature: GYAE6OF01CV0MF.14.25.C03.1.454.CMB.1.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (495)..(495): a, c, t, g, unknown or other
  misc_feature (495)..(495): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcctctggattcaccttcagtacctatgctatcgcacgtcgggtccnccaggctccgaggcgagggctgggagtgggtgacgtattatatcacntgaatggaaactatagacgctagcgcccgagtccgtaggaacggccattccacctactcctaccgaagacgaactaaacttcccgaaagaaccacgacagtactctacgaacaaagtacgaacaggcctagagagcgtgaggacncggcttgtagttactagtggtagggagagagtggtaaggtgtaagtgttggtagg

SEQ ID NO: 272225 - DNA, 656 bp, Homo sapiens
  misc_feature: GYAE6OF01CMI67.14.25.C03.1.454.CMB.1.raw
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
tcagcgtctagtaccacgaccggtgctcgatttagtagtgtagatttgggtttgggggagacgagcccagcactggaagtcgccggtgtttccattcggtgatcagcactgaacacagaggactcaccatggagtttgggctgagcggtcgtttcgcgtaggcgtcttaagaggtgtcagtgcagtgcagctgtgagtcgtggggngngtgcgcgcgtggcgtcgtgagcgtcgtcgtgtgcgacgcgtcgtgtacttctaccttacgtacgtacgtacgtacgtcgtacgtcgcgtcgtcggtccgccgacgtcgtcgacggcggacggtcggtggtggtgggtcggtcgtaggtgtggtaggtagtacggtaacggtaagtaagtaagtaaagtacgtacggaccggacggtacggtacgaacggtacgtacgtacgtacgtacgtacgtacgacgtacgtaacgtaacgtacgtaacgtaacgtacgtagttacgtacgtacgtacgtaacgtaacgtagtaacgtacgtacgtacgacgacgtacgtacgtacgtacgtacgtacgttacgttacgttacgtacgtacgtacgtagtacggtaggtacgggtagggttacggtacgtacgtacgtacggttagttagttacg

SEQ ID NO: 272226 - DNA, 643 bp, Homo sapiens
  misc_feature: GYAE6OF01C29XW.14.25.C03.1.454.CMB.1.raw
  modified_base (159)..(159): a, c, t, g, unknown or other
  misc_feature (159)..(159): n is a, c, g, or t
  modified_base (317)..(317): a, c, t, g, unknown or other
  misc_feature (317)..(317): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttccncgttgcttcttttaagaggtgtccagtgtcaggtgcagctgggtgagtcgtgggggagcgtggtccagccgtgggacgtccctgagctctcctgtcgcagtcctgtggacttccacctttcgagttaccctatcgcttatcgctacgtcggggtcccnccgaggtcctccggaggcggaggggtctgggaggtgggtcgcgtattanactnaacgtgtagaagtacggaaacttaagtaacgcgtctagtccgaccgtacgtcggtaggaacggtctactccactacgtctaccgagacgtaactaacttaccgaacgtaccacgacgagttacttcaagaactaacgtacgaaccgtacggtaccgtaggaacgtacggtacgtacggaacgggtaccgtacggtaccgttagttacggtacttacggtagggtagggacgtaggtaggtacgggtagtacgtaaggttggttggttacgggg

SEQ ID NO: 272227 - DNA, 868 bp, Homo sapiens
  misc_feature: GYAE6OF01CTMVT.14.25.C03.1.454.CMB.1.raw
  modified_base (309)..(309): a, c, t, g, unknown or other
  misc_feature (309)..(309): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatgggagtttgggctgagctgggttttcctcgttgcttcttttaagaggtgtccagtgtcaggtgcagctgggtggagtcgtgggggagcgtggtccagccgtggggagtccctgagctctccgtgtcgcagcctgtggattccacttcagtacctatgctatcgcaccgtggggtcccnccgaggcctacccgagggccggaggggcgtagggagggttggggtggtaccgtaatttaacgtatccaacgtagtggaaacttacggggaaaacttaaagtacggaacgtccgttaagttccggaccccggtaacgtttaccccggggtagggaaaaacccggggggtccccgttaaacgtttacccctaaacccgaacctttaccccgtaaccccgaaaaggttaaaccggaaaacccgttaaaaacctttaccccggaaaaacgggaaaacccctaaacccgggaacgtaaaccgggtttaactttaacccgtaacggaaaacctaaaaggtttaaccgaaaaccgtacccggtaacccgttaacgggaagggaaccgtaccgggttacggaaaccggggtaaacccggttaccggggtaccgttttaaggggtttacggtttaaaaccgtttccgggttagggggtaaaagggggttaccggggaaaggtttagggtaaccggggggttaagtttacgggtttaaaagtttagggtttaacgggggtttaaggggg

SEQ ID NO: 272228 - DNA, 696 bp, Homo sapiens
  misc_feature: GYAE6OF01CICXB.14.25.C03.1.454.CMB.1.raw
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctggagcggtggtttcgcgtaggctcttaagaggtgtcagtgtcaggtgcagntggtggagtcgtgggggagcgtggtccagccgtgggcggtccnggagctctctgtgcagcctgtaggtnttccaccgttnagtactagtcgtctagtgccgtacggtccgggcccgacgacggtcctaccggagggcgggacgggtcgtagggtagggtgggtaggtacgtagttaacgtaacacgtacgtaagtagtaacgtaacggtaaacgtaaacgtaacgtacgtacgtacgtacgtaccgtaccggtaccggtacgggtaacgggtaccgtaccgtaccgtaccgtaccgtaccgtacgtaacgaacgtaacgtaacgtaacgaacgaaacgaacgtacgtacgtacgtacgtacgaacgaacgtaacgtaacgacgtacgtacgacgacgtacggtacggaacggacggtacggtacggtaggttacgttacgttacggtagggtagggaggtaaggtaggtacggtacggtaggtagttaggttagggtacggg

SEQ ID NO: 272229 - DNA, 585 bp, Homo sapiens
  misc_feature: GYAE6OF01EXB0S.14.25.C03.1.454.CMB.1.raw
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcacgtggtccncaggctcgaggcgagggctggagtgggtggcgattantcanatgatggaactaatagacgctatcgacccgtactccggtggaacgggcccgtattccgaacctactcctaccagaacgaacaacttacccaaagaaccacgacagtactctagacaaatagaaacacggcctaggacgagcgtaggacggaacgacggtcttaggtaggttaattacgttaggggtaggggaacggaaggaaggttggggaacgggttacaagtttaggttagggttaagggg

SEQ ID NO: 272230 - DNA, 627 bp, Homo sapiens
  misc_feature: GYAE6OF01DTS8H.14.25.C03.1.454.CMB.1.raw
  modified_base (175)..(175): a, c, t, g, unknown or other
  misc_feature (175)..(175): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagnggtgtccagtgtcaggtgcagctggtggagtcgtgggggaggcgtggtccagccgtggggacgtccctgagacctctcctgtgcagcctctggattccaccttcagtacctatgctangcacgtcggggtcccnccaggcctccgagggcggaggggctgggaggtggggtggacgtattatatcaactatgagtaggaacttaagtacggactctagtcgcccgtaacgtccggtaggaacgggtccgtaacttacccgaaccctattcctaccgaaggacgaaacctaaacttacccgaaacgaaccgaaccgactaacggttactacgtagaacctaaagtacgaaacacgtccgtagaggacgcgtaggaacggtaccgacggtcgttggtagttacgttacgtgggtagggagaggtagtgggtaacggtagtattagttggtaggg

SEQ ID NO: 272231 - DNA, 571 bp, Homo sapiens
  misc_feature: GYAE6OF01BTYWF.14.25.C03.1.454.CMB.1.raw
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (409)..(409): a, c, t, g, unknown or other
  misc_feature (409)..(409): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctcctgtgcagcctgtggattcaccttnacgtacctatgctangcacgtgggtccgccaggcctccgaggcgagggctgggagtgggngctatanatcacatgataggaaactaagagacgtctagtcgaccgtactccggaggaacgggcctattccgacntcctcgagacaactaactaccaagaacacgagtacgtactctagaactaagtcgaactacgacgtagagtacgacgtaggacgacgacggtctaggttcgtaacgttcgagggtacggagtagaggttacggggtaacgtagtaagttggttggttaacggg

SEQ ID NO: 272232 - DNA, 595 bp, Homo sapiens
  misc_feature: GYAE6OF01D1IT4.14.25.C03.1.454.CMB.1.raw
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (375)..(375): a, c, t, g, unknown or other
  misc_feature (375)..(375): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcctctggattcaccttcagtacctatgctatgcacgtgggtccnccaggcctccgagggcggaggggctgggagtgggtggcgtattanatcacatgataggaaactaatagacgntaagtcgccgacgtccgtaggaacgggccgtattccacctatcctccaagagaacctaattacccaagaaccacgacagtactctagacaaatcgaaacacgcctagaaggagaccgtaggacggaacgaccgggtcttaggttacgttaacgtttacgttagggtaggggaaggtaaggtaagtggggtaacggttacggtaagttagttggttaaggg

SEQ ID NO: 272233 - DNA, 551 bp, Homo sapiens
  misc_feature: GYAE6OF01CMJHY.14.25.C03.1.454.CMB.1.raw
  modified_base (301)..(301): a, c, t, g, unknown or other
  misc_feature (301)..(301): n is a, c, g, or t
  modified_base (381)..(381): a, c, t, g, unknown or other
  misc_feature (381)..(381): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggagtccctgagactctcctgtgcagcctctggattcaccttcagtacctatgctatgcactggggtcccnccgaggcctccgagggccggaggggctgggacgtgggtggacgtattatactcacatgaatggaaactaatgacgctaancgcgactcgtagaacgggccatcacactctacagagacaattaccaagaacacgacagtatctagaacaaatacgaacacgacctgaacgagcgtagaacgacacggactagtagttaagttagtaggagacgaaagtacgtacgggtacggtagtctggtcgtcccggg

SEQ ID NO: 272234 - DNA, 614 bp, Homo sapiens
  misc_feature: GYAE6OF01AQWZM.14.25.C03.1.454.CMB.1.raw
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgacgactctcctgtgcagcctntggacttcaccttnacgtacctagtgctatgcctacgtcgggtcccnctaggcctccgagggcggaggggctgggaggtggggtgcgtattatatcacagtgaatacgggaaactaatacggacgtctagtacgcccgtaactccggtaggaacgggtccgtaactccaaccgtactcctacgaagtaacgaactaagttaccaacgaacacgactagtatcgacgtaccaaatcgaacacgtacctaggtacgagcgtacggacggaccacggtcgtaggtacgttagttacggtacggtaggggagaggttaggtacgggaaggttacgtaagttcggttgggttacggg

SEQ ID NO: 272235 - DNA, 658 bp, Homo sapiens
  misc_feature: GYAE6OF01CUXPT.14.25.C03.1.454.CMB.1.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (588)..(588): a, c, t, g, unknown or other
  misc_feature (588)..(588): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggttttcctcgttgctcttttaagaggtgtccagtgtcaggtgcagctggtggagtcgtgggggagcgtggtccagccgtggggacggtccctgagactctccgtgtcgcagccttcgtggtactttccacctttnacgttaacctntcgctatcgcacgtcgggtcccaccgacggtcctccgaggcggagggtcgtgggaggtgggtgacgtagttatatcgaacagttaggaacttacgggaaaacttaaggaacggacgtactaagtccggaacccgtacgttcggtacggaaccggcgtacttaccgaacctacgtcgaccgaagtacgaacttaaactaccgaaacgaaaccgacgtacgtaacgtaactacgttacggaaactaaagtaacgaacaaccggactaggacgaacgttacgagaccgggaacncggtcgttagtaacgtaagttacgtggggtagaggtaagtagtacgggtaggtactagttgttaggtagg

SEQ ID NO: 272236 - DNA, 557 bp, Homo sapiens
  misc_feature: GYAE6OF01ALBTV.14.25.C03.1.454.CMB.1.raw
  modified_base (372)..(372): a, c, t, g, unknown or other
  misc_feature (372)..(372): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggaggtccctgagactctcctgtgcagcctctggattcaccttcagtacctatgctatgcacgtcgggtcccgccgaggcctccgaggccggaggggctgggaggtggggtggcgtattatatcacatgataggaactaanagacgctagtcgccgtactccggtaggaacgggccgtattccacctatcctccagacgactaacttaccaacgaaccacgactacgtatctacgactaagtcgaacacgctagagagacgtagacggacacggctaggtagttactagtggtgggagagaggtagggagtagattgttggtaggg

SEQ ID NO: 272237 - DNA, 533 bp, Homo sapiens
  misc_feature: GYAE6OF01B0LSG.14.25.C03.1.454.CMB.1.raw
  modified_base (433)..(433): a, c, t, g, unknown or other
  misc_feature (433)..(433): n is a, c, g, or t
  modified_base (494)..(494): a, c, t, g, unknown or other
  misc_feature (494)..(494): n is a, c, g, or t
tcagcgtctagtaccacgaccggtgctcgatttagtagtgtagatttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaaagaacacgcagtatctgacaaatgaacagcctgagagctgagacacggctgtgtattacgtggtagggagagagtgggaggtcgtatagttgtagtggtggtagntgactataacgtggactccgacccgtcgggccgacgggaccgtcggtccaccgtctcctcncgccctccaccgacggcccagtccgtcctccccgtccgg

SEQ ID NO: 272238 - DNA, 616 bp, Homo sapiens
  misc_feature: GYAE6OF01DNIZL.14.25.C03.1.454.CMB.1.raw
  modified_base (164)..(164): a, c, t, g, unknown or other
  misc_feature (164)..(164): n is a, c, g, or t
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (500)..(500): a, c, t, g, unknown or other
  misc_feature (500)..(500): n is a, c, g, or t
tcagcgtctagtaccacgaccggtgctcgatttagtagtgtagatttgggtttggggggagacggagcccagcactggaagtcgccggtgtttccagttcggtgatcagcactgaacacagaggactcaccatgggagttttggggctggagcggtcggtttcncgtaggcgtctttaagaggtntcagtgtcaggngcagtcttggtgagtgtggggngcgtgccngccgtgggagtccngagtctcnccgtncgcgagcctgngtattccaccttcgatactgtnctanacgntcgttcgggcacgngcncggagtcgaggcgngngtggnacgtatancgcagaatgancgtaaacancgaacgtcagcgccgancggngacgggtccttanacactagtccgngaaggtacaataacaccggaacgaattacccggatacgttaactacgtaacgtaaacgaacgttcgaacgtcggccgggtaaggacgggttanaccggtacggaacggtccgtaccggtctacggtttcggtaaccgttagggacgggttaccgacggtaacgggttcgggtacggttacgggtacgttacgttacggttgggtacggg

SEQ ID NO: 272239 - DNA, 862 bp, Homo sapiens
  misc_feature: GYAE6OF01DRTBL.14.25.C03.1.454.CMB.1.raw
  modified_base (183)..(183): a, c, t, g, unknown or other
  misc_feature (183)..(183): n is a, c, g, or t
  modified_base (430)..(430): a, c, t, g, unknown or other
  misc_feature (430)..(430): n is a, c, g, or t
tcagcgtctagtaccacgaccggtgctcgatttagtagtgtagatttgggtttgggggggagacgagcccagcactggaagtcgccggtgtttccattcggtgatcagcactgaacacagagactcacagtggtagtttgggctgagtcgttgggttttcctcgttgctttacgttttaaggnggttcgtcctagtgtcgaggtgcagcgtgggtggagtcggtggggggacgtcggtcggtcccaggtccgtaggggtaccgttcccgtaggacgtaccttcctccgttggtcgcctaccggtcccttcggtaggtacctttcccgtaacccttttcgaacgttacccttagtcgtacttaagtcgtacctacggttccggggtcccgccgacggtccctaccggagggtcgggagggtcgttaggggnggttcgggggtacgtacgttaagttttaacgacgttacaacgttagtaggtaacggttaacggtaaaaccttaaaggtacggaaccgtcttaacgcccgggtaaccctaccggtttcgggaacgggtaacccgggtccttaacgttaacccgaccttaacttacccgaaccgaaacggtaaccgtaaaaccgttaaaccgttacccgaaaacgtaaccgaccgtagtaacgttacttacgaaggaaaccctaaagtaaccgtaaccgacgtaccgtaggaacggtacgtacggtaacgggaacgaacccggtacgggtacttagggttaacgtttaacgtttacgggtagggttaacggggaacggtagggtaacgggttacgggggtttaacgtacggttaaaggttttgggttaacgggtttaacggggg

SEQ ID NO: 272240 - DNA, 618 bp, Homo sapiens
  misc_feature: GYAE6OF01BEF5I.14.25.C03.1.454.CMB.1.raw
  modified_base (304)..(304): a, c, t, g, unknown or other
  misc_feature (304)..(304): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggaggtccctgagactctcctgtgcagcctctggattcaccttcagtacctatgctatgcacgtcgggtccnccaggcctccgaggcggaggggctgggaggtgggtggcgtattatatcacatgataggaaactaagtacgacgctagtcgcccgtacgtccgtaggaacgggtccgtattccacctatcctaccgaagaacgaacaacttaccaaagaaccacgactaagtactactagacaaagtcgaaacacgacctaggacgaggacgtacgggaacggacgaccgggtcgttaggttagttaacgtttacggtggggtaggggaaggtaaggtaaggttaggggtaacgggttaccgaagttttaggttgggttaagggg

SEQ ID NO: 272241 - DNA, 562 bp, Homo sapiens
  misc_feature: GYAE6OF01AV767.14.25.C03.1.454.CMB.1.raw
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (458)..(458): a, c, t, g, unknown or other
  misc_feature (458)..(458): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagactctcctgtgcagcctctggattccaccttcagtacctatcgctatgcacgtgggtcccnccaggctccgaggcgaggggctgggagtgggtgcgtattatatcacatgatggaactaanagacgntaagtcgacccgactccggtaggaacgggtccgtattcaacctatcctccaagacgactaacttaccaaagaacacgactagtatctanacaaatgaacagacctagagagcgtagacggacgacggtacgtagtacgttattacgtggtacggggagaaggtagtagggaggtacgagttagttggtaaggg

SEQ ID NO: 272242 - DNA, 588 bp, Homo sapiens
  misc_feature: GYAE6OF01BIBCX.14.25.C03.1.454.CMB.1.raw
  modified_base (253)..(253): a, c, t, g, unknown or other
  misc_feature (253)..(253): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtctgggggagcgtggtccagcctgggagtccctgacactctcctgtncaacgtctggattcagtcttcagttagttatggcatgctacgtggggtcccgccgaggcctccgaggccgaagggggctgggaggtggggtggctaggttgtggtggtagtgaacggaagtaagtaagaagtacgtcgaccgacgccggtagaacgggccaattccaacctatcctcagtaacgacaacttaccaaacaactatacgttagtatcgtagaactaaagtagtaatacgcctagaagacgaccgaggacgacgctggtacgttacttacgtgtagtcgaaggagaggtggggaggggttggtacggtagaccgtaggtgtggtaacg

SEQ ID NO: 272243 - DNA, 878 bp, Homo sapiens
  misc_feature: GYAE6OF01B3SMZ.14.25.C03.1.454.CMB.1.raw
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagcgttgggttttccgtcgttgtcttcttttaagaggtgtcagtgtcaggtgcagcgtggtggagtcgtgggggaggcgtggtccaggccgtggggaggtccctgagacctctcctgtgcagccttcgtggtacttcctaccttacgacgttaccttattcggactagtagcccgtaacggttcgggggtccccaccgagggtccccttaccggaacgggggccgggtaacggggggtcgttgggggtagggttggggggttacggacggttaatttaaacgtttacgcctaaacgtagttagggtaattaaacggggtaaaaccttaaagtacgtaaaccgggtccttaaagtcccgggacccggtaaccgtttacccgggaagggtaaacccggggacccggttaacgttccctaacccgtacttacccgtaccgaacggaaacgtaaccgtaaacttaaccgtaaaccgaaaccgtaacgtaccgtaaacgttacgttacctaggaaacctaaaacggtagtaaacccggtacggtacccgttaagggaacggttaccgacggttaagggaaaccgggaccgggtaacccggttaggttaacgggttacggttttaaacggttttaacggggtacgggggtttaagggggaaccgggttaaaggtcggggttaagggggtacggggtttaaacggttagggtttaaacggttttaggggttaacggggg

SEQ ID NO: 272244 - DNA, 607 bp, Homo sapiens
  misc_feature: GYAE6OF01D27WG.14.25.C03.1.454.CMB.1.raw
  modified_base (308)..(308): a, c, t, g, unknown or other
  misc_feature (308)..(308): n is a, c, g, or t
  modified_base (351)..(351): a, c, t, g, unknown or other
  misc_feature (351)..(351): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagcttgggttttcctcgttgctcttttaaggacggtgtccagtgtacaggtgcagctggtggagtcgtgggggagcgtggtccagcctgggacgtccctgagctctcctgtgcagcctctaggattccaacctttcgacgtacctatgctatgcacgtcgggtccncaggcctccgagggcggaggggctgggagtgggtgcgtattantcaactagtgaataggaaacttaagtacgacgctagtcgacccgtaacgtccggtaggaacgggccgtattaccgacctacgtcctaccgaagacgaactaattacccaagaacacgctaagttactctagacaaatcgaacacgcctaggaagacgcgtaggacggaaccacgggtcttaggttacgttaacgtttacggtgggtacggggaagtaggaggttagggaaggttagtaagtttgttgggtaagggg

SEQ ID NO: 272245 - DNA, 726 bp, Homo sapiens
  misc_feature: GYAE6OF01ENHX0.14.25.C03.1.454.CMB.1.raw
  modified_base (308)..(308): a, c, t, g, unknown or other
  misc_feature (308)..(308): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccaggccgtggggaggtccctgagactctcctgtgcagcctctggattcaccttcagtacctatgctatgcacgtcgggtcccncaggcctccgagggcggaggggctgggaggtggggtggcgtaatttagtatccaactagtggaagtagggaaactaaagtacggaaccgtcttaagtcggacccgtaaccgttcccggtagggaaacggggtcccgtaatttccccaacccgtactacccgttacccgaaggtaaccgtaaacctaaactttaccccgaaaaggaaacccaccggtaacctaaggtttactccgttaacggaacctaaaagtccggaaaacctacggtacccgtaggaacggacgaccggttagggaaccgggaaccaccgggtcgttacgggttaggtttaacgtttacgtaggggttaggggaaaggtaggtaaacggttgggggaacgggtttacggtaaagtttacggtttggggttaacgggg

SEQ ID NO: 272246 - DNA, 651 bp, Homo sapiens
  misc_feature: GYAE6OF01CR2T0.14.25.C03.1.454.CMB.1.raw
  modified_base (311)..(311): a, c, t, g, unknown or other
  misc_feature (311)..(311): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagcctggggacgtccctgagactctccgtgtgcagcctcgtggacttccaccttcagttacctatgctatcgcacgtcgggccnccaggcctccgaggcgaggggctgggaggtggggtgacgtattactatcactagtgaattagtaaacctaagtacggaccgtacttagcgacccgaacgttcccggtaggaacgggtccctaacttcccacccgtattccacccgaagaacgaacctaaacttacccgaaagaacccacggactaagttactctagaacctaaatacgaacacggccgtaggaaggtacgcgtacggaacggtaccgacggtcgttaggtacgtttacgttacggtagggtaggggacgtaaaggtcggttaagggtacgggttactaaggttaaggttgggttaagggg

SEQ ID NO: 272247 - DNA, 647 bp, Homo sapiens
  misc_feature: GYAE6OF01CQYTJ.14.25.C03.1.454.CMB.1.raw
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatgggagtttgggctgagcttgggttttcctcgttgcttcttttaagaggtgtccagtgtcaggtgcagctggtggagtcgtgggggaggcgtgggtccaggccgtggggagtccctggacgactctcctgtcgcagcctcgtggattccacctttcgaacgttacctagtcgacttagtcgcctacgtcggggtcccnccgaggcctccgaggcggaggggcttgggagggtgggnggcgtattagtactgacgtatgaacgtaggaaacttaanacggacgtctagtccgaccgtaaccgtcggtaggaacgggtcctacttaccgacctacgtacctaccgaagtaacgaacctaaacgttaccaaacgtaaccgactacgagttaactcgtagaactaagtaacgaacacggtaccgtaggaacgagtacctagggaacgaccgtacggtcgtagttaggtacttaggtgggtacgggagtaggacgtagggtacgttagtaagtagttggtaggg

SEQ ID NO: 272248 - DNA, 665 bp, Homo sapiens
  misc_feature: GYAE6OF01CE1VU.14.25.C03.1.454.CMB.1.raw
  modified_base (403)..(403): a, c, t, g, unknown or other
  misc_feature (403)..(403): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtccctgagactctccgtgtgcagccttcgtggactttccaaccctttcgaacgttacctagttcgcttaatgccacgtcggggtcccgcgaggcctccgagggccggaggggctgggagtgggtggcgtattatactcacgtagtgagtaggaaactaagtagacgntaagtcgaccgtacgtccggtaggaacgggtcctacgttacacctacgtccaccgaagacgtaactaacgttaccaaacgaacacgacgtaagttactctacggaactaagtacgtaacacggtaccgttaggaacgtcgtaaccggtaggtaacgggaccgtacgggtacgttggttaaggttaacgtttaaccgggtgggtagggaaggttaggaaggttacggggtaggtacggtaaaggtttggttagggttaagggg

SEQ ID NO: 272249 - DNA, 664 bp, Homo sapiens
  misc_feature: GYAE6OF01E25LO.14.25.C03.1.454.CMB.1.raw
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggacttcaccttcagtacctagtgctatcgcacgtcgggtcccncgaggcctccgaggcggaggggctgggagtggggtgcgtattagtactcactagtgaagttaggaaactaagtagaccgtctaagtccggacccgtacgtccggtaggaaccgggtcccgtagttcccaccgtacgtccgtaccgaaggtaacgtaactaacgttaacccgaaacgaaccacgtacgtaacgttactaccgtacgaactaaacgtcgaaaccgtacggacccgttaaggaacgtacggtcgtaagggacggaaccgtacgggtaccgttagggttaacgttacgttacggtagggtagggacgtaggtaggttacgggtacggtagttaacgttagggttggttagggg

SEQ ID NO: 272250 - DNA, 580 bp, Homo sapiens
  misc_feature: GYAE6OF01AO604.14.25.C03.1.454.CMB.1.raw
  modified_base (379)..(379): a, c, t, g, unknown or other
  misc_feature (379)..(379): n is a, c, g, or t
  modified_base (461)..(461): a, c, t, g, unknown or other
  misc_feature (461)..(461): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcggtggtccagccgtggggacggtcccctggagactctcctgtgcagcctctggacttccaccttcagttacctatgctatgctacgtcgggtccgccaggcctccgaggcgaggggtctgggaggtgggtggcgtattatatcacagtgagtggaactaanacggactctagtcgaccgactcgtaggaggccgtatccacctatctacagacgaacaattaccaagacgacgacagtactcngaacaatacgaacacgtacctagaagagtccgtaggacggacgaccggtcgtggttagttacgttacgtgggtagggacggaaggagtacggggtaggtacgtagttagttggttaggg

SEQ ID NO: 272251 - DNA, 650 bp, Homo sapiens
  misc_feature: GYAE6OF01BVRN3.14.25.C03.1.454.CMB.1.raw
  modified_base (314)..(314): a, c, t, g, unknown or other
  misc_feature (314)..(314): n is a, c, g, or t
  modified_base (364)..(364): a, c, t, g, unknown or other
  misc_feature (364)..(364): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccaggcctgggacgtccctgagactctcctgtgcagcctcgtggattccacctttcacgttacctatcgctagtcgcacgtcgggtcccnccgaggcctcgaggcggaggggctgggaggtgggtgacgtattagatcanagtgataggaactaagtacgacgtctagtcggcccgtacgtccggtaggaacgggtccgtaattcccgacctacttcctaccgaagacgtaactaacttacccgaaagaaccacgacgtaagttactacgtagaacctaaaggtacgaaaccgtacggtacccgtaggacggtacgtccgtagggaaccggaacgtacgggtccgttaggttacgtacgtttacggtagggtagggaagtacggtaggttacgggagggttaaccgtagtttaggttggtaacggg

SEQ ID NO: 272252 - DNA, 668 bp, Homo sapiens
  misc_feature: GYAE6OF01BJPPE.14.25.C03.1.454.CMB.1.raw
  modified_base (607)..(607): a, c, t, g, unknown or other
  misc_feature (607)..(607): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtggtttcctcgttgctctttaagaggtgtccagtgtcaggtgcagctggtggagtcgtgggggagcgtggtccagccgtgggacgtccctgacgtactctcctgtgcagcctcgtgacttcacctttcacgtaccttagtgctatcgctacggtcggtcccgcaggcctccgagggcggaggggtcctgggagtggggtacggcgtacttatatccgaacataggatagggaaactagtaacgacgtactagtcgccgtaacgtccgtagggaacgggtacccgtattcgacgtctactccgtacccgaagaacgtaacgtaaacttaccgaaaacgtaaccaaccggtactaacggttaacttcggtaacaaacgtaaacgttacgaaacgaccgtaccggtagacgacgtacgtacggaacggacgaccggtcgttaggttaacgttaggtttaacggnggggtaacgggtaaggtacggtagggtaacgggtaggttaacggtagtttgggtttaaggg

SEQ ID NO: 272253 - DNA, 703 bp, Homo sapiens
  misc_feature: GYAE6OF01B0SLX.14.25.C03.1.454.CMB.1.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (574)..(574): a, c, t, g, unknown or other
  misc_feature (574)..(574): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccagtggagtttgggctgagcttgggttttcctcgttgcttcttttaagaggtgtccagtgtcaggtncagctgggtggagtcggtgggggagcgtggtccagccgtgggacggtccctggacgtactcgtcctaggcgacagtcctcgtaggtacttcaacctttnaacggttacctagtcgactaagtcgactacggtcgggcccnccgagccgtaccgaggccggagggcgtgggacggttggggagtccgttaaattagtaacgtccgtaaacagttggaagttaaacgggaaacttaaagtacgggaactcgttaaacgtccggaacccggttaccttaccggggtaagaaccggggtccctacgttacccaccgtattaccgaacgaagtaaaccgaaactaaccttaacgaaaacgaactaaccgactaagtactcgtanaacaaagtacgaaactaccgagtacgagaacggtcagggacgtacgaccggtattcggtaagtacgttaacggtagggaggaagtacggtaagtacggggtacgttaaggtataagggtttgggtacgg

SEQ ID NO: 272254 - DNA, 657 bp, Homo sapiens
  misc_feature: GYAE6OF01B4LI0.14.25.C03.1.454.CMB.1.raw
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (613)..(613): a, c, t, g, unknown or other
  misc_feature (613)..(613): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccagccgtggggacgtccctgagacctctcctgtgcagcctctggattccaccttcagttacctatgctatgcacgtcgggtccnccgaggcctccgagggcggaggggctgggaggtgggtgcgtattatatcacatgataggaactanagacgtntagtcgaccgacgtccggtaggaacgggtccgtaactttccgaaccctatcccgtaccaacggaaacgtaacctaaacttacccgaaaacgaaccgaaccgactaacgttaactcgtacgaacctaaagtacgaaaccgacggtcccgtaaggaacggtacgcgtagggaacggaccgaacgggtcgttaggtacgtttaacgttaggtacggggttagggaacggtaaggnggttaggggtacgggtagttaagtttaggtttagggttaagggg

SEQ ID NO: 272255 - DNA, 738 bp, Homo sapiens
  misc_feature: GYAE6OF01BMJKR.14.25.C03.1.454.CMB.1.raw
  modified_base (317)..(317): a, c, t, g, unknown or other
  misc_feature (317)..(317): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgacgtcgtgggttttacctcgttgtccttcttttaagaggtgtccagtggtcaggtgcgagctggtggagtcgtgggggagcgtggtccagccgtggggacgtccctgagactctccgtgtgcagcctctggacttcaccttcagttacctatgcttatgcacgtgggtcccnccaggcctccgaggcggagggctgggagtgggtgctaggttgtcgtggtatggaacggtaagtaagtaaggaagtagtcgaccggtacgtccggtagggaacgggcctacttaccgaaccgtactccgtacccgaaggtaacgtaacctaaaccttaaccgaaactaaaccgttagttacgtttaacgttacgttaccgtaggaaccttaaaagttacgtaaaccgttacgaaccggttaaggaacggtaccgggtaacccggggtaacggtacccggtaacgggtccgtttaggttaacggtttaccgtttacggttacggttacggtaccggtaagggtaaagggtcgggttagggggggtaagggggttacggttaccggtacgtaacccgggttaagggttacgttgggtttaacgg

SEQ ID NO: 272256 - DNA, 640 bp, Homo sapiens
  misc_feature: GYAE6OF01AWSES.14.25.C03.1.454.CMB.1.raw
  modified_base (346)..(346): a, c, t, g, unknown or other
  misc_feature (346)..(346): n is a, c, g, or t
  modified_base (498)..(498): a, c, t, g, unknown or other
  misc_feature (498)..(498): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagttggctctttcttgtggctattttaaaagatgtccagtgtgaggtgcagctgttggagtccggggagcttggtacaggccggggggtccctgacactctcctgtgcagcctcaggtattctatttttagcgaatatgccatgagcgtcggggtcccgccaggcctaccggaggggaacggggctgggaggtgggtcctnagcaagtcgtaggttggttcgtaggtaggaagtacgagttccggaccgtccgttctccggtaggaacggggtcccggttctcctatcctaccgagacgactaacttccaaagtaactacttctatttctacaattggactagcctaaggaanacgaagaccgacgggtcgttagttagttttgagtaagaacgtagtaacggtagttactagtcggtaacttaacccggtaaggtttggggacgggttcctttacgtagttacggtacggtcggggtaccggaagggtacccgg

SEQ ID NO: 272257 - DNA, 685 bp, Homo sapiens
  misc_feature: GYAE6OF01CUVWA.14.25.C03.1.454.CMB.1.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctgggtggagtcgtggggggagcgtggtccaggccgtggggacggtccctgacgacctctccgtgtgcagcctntggattccacttcagtacctatgctangcacgtgggtcccnccgaggcctccgaagggcggaggggctgggaggtggggngacggtattaatacgtcaactagtgaattagggaaacttaagtaggaacgtcttaagcggacccgaacgttccggtagggaaacggggtccgaactttaccgaaccctacgttacccgttaaccgaacggtaacgaaacctaaaacgttaccccgaaaagaaaccgtaaccgtacgtaacggttaacttaccgtaacggaacctaaagttaacggaaacgtacgaccgtaggacggacgcgtacggaacggtaccgacgggtccttaggtacgttagttaacgtgggtagggaagtaggtagtacgggagtacgtaagttaggttaggttaggg

SEQ ID NO: 272258 - DNA, 846 bp, Homo sapiens
  misc_feature: GYAE6OF01C2GXH.14.25.C03.1.454.CMB.1.raw
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagtcttgggttttcctcgttgcttcttttaaggaggtcgtccaggtgtcaggtgcagcgtgggtggagtcggtgggggagcggtgtccaggccgtggggacgtccctggaacgtctctccgtgtcgccaggtcctcgtggtactttcctaccttcgagtttacgttccgtggacctagtggcctacggtcggggtccccacgacggccttccggaggaccggaagggggcttgggtaggtttgggggtacgggtaagtttagtacgtacgtaagtagtacggtaagtaagggtaaaactaaaagttaaagtaactagtaggacgtaacggtaccgttacccggggtaaggtaaaccggggtacccttaacgttacccgaaccgtacttacccgtaaccgtaacggaaccggtaaaccctaacccgttaacccgaaacggggtaaccctacggtacgtaaccgttacggtaaccgtacggaaacgttaaaggtaccccggaaaactaccgggtaccgtaacgggtaacgtaaccgggacgttaacggggaaccgggaacccggtacgggtaaccgtaacgggtttaacggtttaacggttaaccggtagggtaaacgggtaaacgggttaaaccggtaagggttaaccggggttaggtaacccggtccggttaccgggacccgggttcccgggggtaccccgggg

SEQ ID NO: 272259 - DNA, 741 bp, Homo sapiens
  misc_feature: GYAE6OF01BC497.14.25.C03.1.454.CMB.1.raw
  modified_base (306)..(306): a, c, t, g, unknown or other
  misc_feature (306)..(306): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggacttccacctttcagtacctatgctatgccacgtcgggtcccnccaggcctccgagggcggaggggctgggaggtgggtggcgtaagttatatcgaactatgaatagggaaaccttaagtacgaccgtcttaagtccggaccccgtacgttaccccgggttagggaaaccggggtcccgttaacgtttacccgaaccctacgttacccgttaacccgaaacgtaaacggtaaccttaaactttaaccccgaaaacgaaacccgaaccggtaccaacggttaacttcgtacgaacctaaagtacgaaaccgacgtacccgtaggaacgacgacgttacggaacgggaaccgtaccgggtacgttaggttaacgtttaacggtttaacggttagggggtaacggggtaacgggtaaagggtaacgggttaggggtaaacgggttacggttaaaggttttaaggtttcggggttaaggggg

SEQ ID NO: 272260 - DNA, 628 bp, Homo sapiens
  misc_feature: GYAE6OF01CDK37.14.25.C03.1.454.CMB.1.raw
  modified_base (175)..(175): a, c, t, g, unknown or other
  misc_feature (175)..(175): n is a, c, g, or t
  modified_base (309)..(309): a, c, t, g, unknown or other
  misc_feature (309)..(309): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtggggacggtccctggacgactcctcctgtgcagcctcgtggacttcaccttcagtacctatgctatgcacgtcggtccnccgaggcctccgaggcggaggggctgggaggtggggtgcgtattatatcaactagtgaagtacggaaactaagtacgacgtactagtcgacccgtactccggtaggaacgggtccgtacttccaacccgtattccgtaccgaagaacgaactaacttacccgaaagaaaccaccgacgtaggtactacgtacgtaacaaatcgaactacgaccgtagacgacgtacgtaggacgaacggcggtcgttaggtcgttaagttacggtgggtagggaacgtaggtaggtcgggtagggttagtaacgttggttggttaaggg

SEQ ID NO: 272261 - DNA, 597 bp, Homo sapiens
  misc_feature: GYAE6OF01BPORY.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagcctgggagtccctgagactctcctgtcgcagcctgtggtattccaccttcacgtacctatcgctatcgctacgtcgggtcccgccgaggcctaccgagggcggaggggcgtgggaggtcggggtggcgtaattagtatcacagtgaagtaggtaaactaagtaggacgtctagtcgacccgtacgtccggtaggaacgggtcctacttaccacctacgtcctaccgaagaacgaactaacttaaccaagaacacgactagtactcgagaactaagacgaacagcgtagagacgcgtaggacggacgacggtctaggttcgtaacgttagtgggtaggagaggagtgggtaggtagtagttgttggtaggg

SEQ ID NO: 272262 - DNA, 592 bp, Homo sapiens
  misc_feature: GYAE6OF01EZ1Z3.14.25.C03.1.454.CMB.1.raw
  modified_base (301)..(301): a, c, t, g, unknown or other
  misc_feature (301)..(301): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggagtccctgagactctcctgtgcagcctctggattcaccttcagtacctatgctatgcacgtgggtcccncaggcctccgaggcggaggggctgggaggtggggtggcgtattatatcacatgatggaaactaagtagacgtctatcgccgtaactccggtaggaacgggccgtattccacctactcctaccaagaacgaactaacttaccaaagaacacgacacgtactctagactaaatagaaacacgaccgtagaacgagcgtaggaacggacgacggtctaggttacgttaactttacggtagggttgggaggtaaggaaggtggggtaggttacgtaagttagttcgggttaaggg

SEQ ID NO: 272263 - DNA, 716 bp, Homo sapiens
  misc_feature: GYAE6OF01DBYYF.14.25.C03.1.454.CMB.1.raw
  modified_base (340)..(340): a, c, t, g, unknown or other
  misc_feature (340)..(340): n is a, c, g, or t
tcagcgtctagtaccacgaccggtgctcgatttagtagtgtagatttgggtttgggggggagacgagcccagcactggaagtcgccggtgtttccattcggtgatcagcactgaacacagagactcaccatggagttgggctggagtcgttgggtttttcctcgttgtcttcgtttttaaaggaggttgtcctagtgtcgaggtgcaggtctgggtggaggtcggtgggggagcggtggtccagccgtggggacgtccctgacgtcctctcgtgtcgcagtcctcaggtacttccaccttcaagttacctatcgtctagtcgctaccggtcggggtcccnccgtaggcctccggaaggggcggtaggggctaggggtagggttcgggcggtaagtaagtttaacgtacttaccgacgtaagttggaaagtacgggtaaaacttaaagacgtacgtaccttagcggacccgacgttaccggggtacgaaacgggtccgtacttacccgactacgttaccaaccgaagaacgtaaacctaaacgtaaccgaaaccgtaacgaccgtaacgtacgtaacgttctaacgaactaaacgtacgaacgacgtacgtaggaggtacgacgtagggaacggaccggtaggttccgtaggttacgttaagttacgtagggtaagaggtaggtaggtacgggtaggttagtattagttggtacggg

SEQ ID NO: 272264 - DNA, 638 bp, Homo sapiens
  misc_feature: GYAE6OF01BMI7X.14.25.C03.1.454.CMB.1.raw
  modified_base (308)..(308): a, c, t, g, unknown or other
  misc_feature (308)..(308): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggaggtccctgagactctcctgtcgcagcctctggacttcaccttcagtacctatcgctatcgcacgtcgggtcccnccgaggcctccgaggcggaggggctgggaggtgggtggcgtattagtactcgaactagtgtaagtacggaaactaagttacggacgtctaagtcggacccgacctccgggtaggaaacggggccgtaacttaccgacctatcctaccaacggaacgtaacaaacgttaccaacgtaacgaccgactagtactctagaaccaaagtacgaacacgaccgtagaacgagtcgtaggaacggaaccgtcggtacgtggttacggtaactttaccggtgggtacgggaagagggtaacggtcgggtaaggtacgtagtttagttggttaagggg

SEQ ID NO: 272265 - DNA, 691 bp, Homo sapiens
  misc_feature: GYAE6OF01EQHIW.14.25.C03.1.454.CMB.1.raw
  modified_base (263)..(263): a, c, t, g, unknown or other
  misc_feature (263)..(263): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagacctctccgtgtgcagcctntggattccaccttcagtacctatgctatgcacgtcgggtccgccaggcctacggaggcggaggggctgggaggttggggtggacgtaatttatagtacacgtataggaatacgggaaactaagtacgacgtcttagcgaccgtaacgtccggtaggaaccgggtccgtacttcccgaaccctagttacctaccgtaacgaacgtaaacctaaacgtttaaccccgaaaagaaaccgaaccgtacgtaagttactacgttacgaactaaaagtacgaaacgtcgacccgtaggacgtacgtacgtaggaacgggaaccgtacgggtccgttagggtttacgttaacggtttacggtaggggttaggggaacggtaaggtaacggttaggggtaacggttacggtaagtttacggtttagggttaagggg

SEQ ID NO: 272266 - DNA, 735 bp, Homo sapiens
  misc_feature: GYAE6OF01A27TI.14.25.C03.1.454.CMB.1.raw
  modified_base (262)..(262): a, c, t, g, unknown or other
  misc_feature (262)..(262): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctggggagtccctgagactctcctgtgcagcctntggattccaccttcagtacctatcgctatgctacgtgggtcccgccgaggcctaccgagggcggaggggctgggaggtggggtggcgtattagatcacagtgataggaaactaagtacgacgtctagtcgacccgtacgtccggtaggaaccgggtccgtattacccaaccctacgtcctacccgaagtaacgaacctaaacgttaacccgaaacggaaaccgacgtaccgtaaagttacttaccgtacggtaaaccctaaaagtccggaaaacctacggtacccgttagggaaacggtacggtaccggtaacggggaacgggtaacccgtaaccgggttaccgtttagggttaacggtttaacgttttaacggtacggggggttaacggggaagggtaaaggttaacggggttaagggggtaaccgggtttaaacggttaaggttttaacggtttaggggtttaacgggggg

SEQ ID NO: 272267 - DNA, 719 bp, Homo sapiens
  misc_feature: GYAE6OF01AENC8.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtccctgagactctcctgtgcagcctctggattccacctttcagtacctatgctatgcacgtgggtcccgccgaggcctccgaggcggagggggctgggaggttgggtggacgtattatactcacatcgagtaggaaacttaagtacggacgtactagtcggacccgtaccgttccggtagggaacggggtcccgtaactttaccgaaccctacttacctacccgaacggtaacgtaacctaaactttaaccccgaaaacgtaaaccgaaccggtaccgtaacggttaacgtaccgttacgaaccgtaaaagtacggaaaaccgtacggtacccgttaagggaacggacggtacgtacgggaacgggtaacgaacgggtccgttaggttacggtttaacgtttacggttacggggttaggggtaagggaacggtagggttaggggtaacgggttagggtaagttttaggtttagggttaagggg

SEQ ID NO: 272268 - DNA, 879 bp, Homo sapiens
  misc_feature: GYAE6OF01CC6VF.14.25.C03.1.454.CMB.1.raw
  modified_base (62)..(62): a, c, t, g, unknown or other
  misc_feature (62)..(62): n is a, c, g, or t
tcagcgtctagtaccacgaccggtgctcgatttagtagtgtagatttgggtttggggggganacgagcccagcactggaagtcgccggtgtttccattcggtgatcagcactgaacacagagactcaccagtgggtagtttgggctggagtcgtttcgggtttttccctcgttgtactttacgttttaaaggaggttcgtccgagtcgtcgaggtgcaggtcgtgggtgggacggttcgggtggggggacggtcggttacggtccgacggtcccggtagggggtaccgttcccgtaggaaccgttcctttcccgtccgtaggtccgaccgtaccgtccgttaacgtcggttaacctttaccctaaccccggttataacggttaccctagttccggtacttacgtcggtcccgtacgggttccggggtaccccgacgacgggtccctacgggacggggccggtagggggtcgtagggacgggtgggtacggtactaatttaacacgtctaagtaggtaacgtaaggtaaacggtaaaccttaagaccgtaacggtactacgcccggtaccgtaccggtacgggtaacggaaccggttaccctagttacccgacctaccgtaccgtaaccgaagtaaccgtaactaaaccgtaacgaaccgaaacgtacgtaacgtactaacttacgaacgtaaacgtaacgtaaccgaacgtaacggtccggaaagaccgtaagggtaccgtaacggggaacgtaccgggtaccggttacgttaacggttaggttaacgttacggggtaaggggtacgggtaagtaacggttacgggtacgggttaacggtttaccgtaaaggttttacggggtagggtttaaacggggg

SEQ ID NO: 272269 - DNA, 676 bp, Homo sapiens
  misc_feature: GYAE6OF01AUMAB.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggtccagccgtggggacggtccctgacgacctctcctgtcgcacgtcctcgtggacttccacctttcacgtacctatgactatcgctacggtcgggtcccgccgaggcctccggaggcgggaggggtctaggggaggtggggtcgacgtaattatactacgaactatgataggaaactaagacgacgtctagtccgccgtaacgtccggtaggaacgggccgtactaccacctagtacctacgaagaacgtaactaaacttaaccgaaacgaaccgacgacgtaacgtactacgtacgaacctaaagtaacgaaccgacggtacccgtaggaacggacgtacgtagggaacggacgtaccggtcgttaggttacgtttaacgttacggtagggtaggggaaggtaaggtagggtaggggtaacggttaggtaacgtttaagggttggttaagggg

SEQ ID NO: 272270 - DNA, 703 bp, Homo sapiens
  misc_feature: GYAE6OF01DT7PP.14.25.C03.1.454.CMB.1.raw
  modified_base (435)..(435): a, c, t, g, unknown or other
  misc_feature (435)..(435): n is a, c, g, or t
tcagcgtctagtaccacgaccggtgctcgatttagtagtgtagatttgggtttgggctgagctgggttttcctcgttgctcttttaagaggtgtccagtgtcaggtgcagctggtggagtcgtgggggaggcgtggtccagccgtggggaggtccctgagactctcctgtgcagcctctggattcaccttcagtacctatgctatgctacgtcgggtccgcaggcctcgagggcggagggctgggaggtgggtggacgtattaatataccgacagtgataggaaacttaagtagcgctagtcgccgtacctcggtaggaaacgggcctattcccaacctagtccctacgaagaacgaactaaacttccgaaaagaaccacgactagtactgtacgaacaaagtcgaacagcctaggacgagtcgaggaacggacncggtagttagtagttaagtacgtgggaaggtacgagtaggtaggtacggtacgtaagttaggtttagtacgggtgggtaggtacgtcgtacggttaccttaaagtaccggtacgggtaaccgtcccggtaacccgggtcggggaacccgtaccgggtacccgttcggtaccccgaccggttctaccccgtcgtacccggtacccctacccgaaacccggaccgggtacccctacggttcccccggttcccttaccccccggtacccgg

SEQ ID NO: 272271 - DNA, 824 bp, Homo sapiens
  misc_feature: GYAE6OF01EM0QD.14.25.C03.1.454.CMB.1.raw
  modified_base (442)..(442): a, c, t, g, unknown or other
  misc_feature (442)..(442): n is a, c, g, or t
tcagcgtctagtaccacgaccggtgctcgatttagtagtgtagatttggggtttggggggggagacgagcccagcactggaagtcgccggtgtttccattcggtgatcagcactgaacacagaggactcaccatggagtttgggctgagcgttgggttttcctcgttgcttcttttaaggaggttgtccagtgtcaggtgcagcgtggtggagtcggtgggggagcggtggtccaggccgtgggacggtccctgacgtacctctccgtgtcgcagtcctcgtggtacttcaccttcacgtacctagtcgctagtgctacgtcgggtcccgccgaggcctaccggagggcgggacgggggtctggggacgggttggggtcggtacgttaagtttagtactacgaactagtaggtaactagggtaaattaagtacgtaaccgtnttaacgtaccggcccgtaaccgttccgggacgggtaaccggggtacccttaacgttaccctaacccgtaacttacccgtaccgaaacggtaacgtaacctaaaccgttaacccgaaaacgtaaacccgaccggtaaccgtaacgtttaccgtacgttaacgaaaccttaaaaaggtaccgaaaccggtaaccggtccgttaacgggaaacggtaccggtacgggtaacgggaacgggaacccggttaacgggtccgtttagggttaaccggttttaacgttacggggttaaggggtacggggggaaacgtaagggggttaacggggttaagggttacggggtttaaacgttaggttttaacgggttaggggtttaacggggg

SEQ ID NO: 272272 - DNA, 697 bp, Homo sapiens
  misc_feature: GYAE6OF01ET9JA.14.25.C03.1.454.CMB.1.raw
  modified_base (382)..(382): a, c, t, g, unknown or other
  misc_feature (382)..(382): n is a, c, g, or t
tcagcgtctagtaccacgaccggtgctcgatttagtagtgtagatttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcacgtgggtccgccaggctccgaggcggaggggctgggagtggggtggacgtattatatcaacatgataggaactaatagacgctatcgccgtactccgtaggaacggccgattaccaccatctaccagacgaacaacttccaaagaaccacgacagtactcgtagacaaatcgaaacncgcctagacgagtcgtaggaacggaccgaacggtcgtaggttagttaacgtttacggtaggggtagggaagtaggtaggtagggtaggtacgtaagttagtttaggttaggttgggttaggtagtcgttagtacgttaacgttaacggtacggtacgttccccggtaaccccgggtacggggacccggtaacggggtaccccgtgggtaccccgacccgttccctaccgtacccgaccggtaccccctaacccggaaacccggtaaccggggtacccctaacggttccccggtttccccgtccccccgtacccgg

SEQ ID NO: 272273 - DNA, 654 bp, Homo sapiens
  misc_feature: GYAE6OF01ED653.14.25.C03.1.454.CMB.1.raw
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (558)..(558): a, c, t, g, unknown or other
  misc_feature (558)..(558): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggacgtccctgacgactctcctgtgcagcctgtgattccaccttnagtcctatgctangcacgtcgggtcccgcgaggtcctccggaggcgggaggggtctgggaggttggggtacgcgtaatttacgtatccgaatagtagtaacgttacggaaactaagtacggacgtctacgtcgcccgtacgtccggtaggaaccgggctaacttaccgacctacgtccgtaaccgagtaaacgaaccttaacgttaaccgaaacgtaaccgaacgtcgtaagttacgtcgttaagaacctaagtaacaacgacgtccgtagaacggacgngtacggacggaccgaaggtcgttaggttagtaacgtttacgtgggttaacgggagtaggtaaggtacggggagttagtaattggttggttaacggg

SEQ ID NO: 272274 - DNA, 637 bp, Homo sapiens
  misc_feature: GYAE6OF01CL1XL.14.25.C03.1.454.CMB.1.raw
  modified_base (411)..(411): a, c, t, g, unknown or other
  misc_feature (411)..(411): n is a, c, g, or t
  modified_base (530)..(530): a, c, t, g, unknown or other
  misc_feature (530)..(530): n is a, c, g, or t
  modified_base (545)..(545): a, c, t, g, unknown or other
  misc_feature (545)..(545): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagcttgggttttcctcgttgtcttacgttttaaggaggtcgtccagttgtcagggtgcagcgtgggtaggaggtcggtggggggaggcggtggtccaggcccgtggggacggttccctaggaacgtcctcctccgtgtcgcacgtcctcgtgtacttccaccttgacgttacctagtggacttagcgctacggtcgggtccccgacgacggccctcggagggccgggagggcgtgggaggtcggggtggacgtattagtactcanagtgagtagaactaatcgacgtctaagtcgtaccgaccgttcggaggaaccgggtccgtacgtccacctactacctacgaagaacgaactaacgtaacaacgaaccacgacctagtacnctagacaatcgaacncgacgtagagagacgtaggacgaccgaggtctagtacgtagttaggaggtagggagaggtacggtaggtacggtagtagttggttgttaggg

SEQ ID NO: 272275 - DNA, 843 bp, Homo sapiens
  misc_feature: GYAE6OF01B1UUW.14.25.C03.1.454.CMB.1.raw
  modified_base (770)..(770): a, c, t, g, unknown or other
  misc_feature (770)..(770): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcgaggtgcagcgtggtggagtcggtggggggagcgtggtccagccgtgggacggtccctgacgtacctctccgtgtgcacgtcctcgtacgtactttaccgacctttacaacgttaacccttagttcggtaccttaagtcggtacccgtaccggttccgggggtccccgaccggaaccgggtccccttacccggaggggccgggtaacgggggccggttggggtaacggggttcggggttcgggtacggttaattttaaacgtacgtacgaaaccgtagtacggtaagttaacggggtaaaaccttaaaggtacgtaaccgtacgtttaacgcccgggaaccccggttaaccgttaccggggtacgggaaaccgggtaccccgttaacgttacccgaacccttaaccgttccccttaacgaaacgtaacgaaacctaaacgttaaccgaaaccgaaacgtaaccggacctaacggttaactccgtaagaaccgtaaagtaaccgaacgtacgaccgtaggaacggtacgtacggacgaacgggtaccgtacggtcgttaggttacgtttaacgttacgggnggggttaaccggaggttaagggtacggtaggggttaaccggtaggttaaagtttcggggttagttaacggggg

SEQ ID NO: 272276 - DNA, 677 bp, Homo sapiens
  misc_feature: GYAE6OF01DW8TQ.14.25.C03.1.454.CMB.1.raw
  modified_base (302)..(302): a, c, t, g, unknown or other
  misc_feature (302)..(302): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggagtccctgagactctcctgtgcagcctctggattccaccttcagtacctatgctatgcacgtgggtcccnccaggctccgaggcggaggggctgggagtgggtggcgtattatatcactatgataggaactaatagacgtctagtcgaccgtacgtccggtaggaaccgggtccgtaattcccaacccgtattccgtacccgaaggtaacgtaacctaaacgtttacccaaaggtaaacccaccggtacctaacgttaacttcgtacgtaactaaacgtacgaaacgaaccggtaccgttaggaacggaggtaccgtagggtaaccgggaaccgaaccgggtccgttagggttacgttaacgttttacggtggggttaggggaaacggtagggttaaggtacgggggttaacgggttcggttaaagttagggtttggttaagggg

SEQ ID NO: 272277 - DNA, 692 bp, Homo sapiens
  misc_feature: GYAE6OF01CPTES.14.25.C03.1.454.CMB.1.raw
  modified_base (247)..(247): a, c, t, g, unknown or other
  misc_feature (247)..(247): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
tcagcgtctagtaccacgaccggtgctcgatttagtagtgtagatttgggttggggggagacgagcccagcactggaagtcgccggtgtttccattcggtgatcagcactgaacacagaggactcaccatggagtttgggctgagcttgggttttcctcgttgcttacttttaaggaggtgtccagtgtcaggtgcagcgtgggtggagtcggtgggggagcgtggtccaggccgtggggacgtccngacgctctccgtgcgcacgccttcgngtacttcaccttnaacgttacctatgctatggaccgtgggtccncaggctcggaggcggagggctgggagtgggtcgacgtatttanactcaanattaggaagtaacgggtaaacttaaagtacggaaccgtntttaagccggtaccggaaccgttccgggtaaggaaaccggggccctaattcaacctaactccgtaccgaaggtaacaaacctaaacttaaccgaaagaacgacacgtaagtacctacgtacgaactaaaacgtaacgaaacgaacggtcctaggtaacggaagccgtaagggaacggtaaccgtaaccgggtgttacggtttaagtaagtttaccggtagggtaagggaaggaaggtaccggtagggtaacggttgtaaagtttaggttagggtagggtttagggg

SEQ ID NO: 272278 - DNA, 622 bp, Homo sapiens
  misc_feature: GYAE6OF01CZWNK.14.25.C03.1.454.CMB.1.raw
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctgggtggagtcgtgggggaggcgtggtccagccgtggggacgtccctgagacctctcctgtgcagcctcgtggtacttccaccttcacgttacctatgctatgcacgtcgggtcccnccgaggcctccggagggcggagggggtctagggaggttggggtacggacgtaatttagactccgaatntaggaattagggaaactaagtcgaacgtctaatcgaccgtacgtcggtaggaacgggtcctagttccaacctactacctaccgagaacaactaaacgttaccaaagaaccacgtacgagtactcgtagaactaaagtagaacacgaccgtagaacgagcgtaggacggaccgacggcgttagtagttagttacgtgggtagggagaggtaggtgggtaggtcgtagttagttggtaggg

SEQ ID NO: 272279 - DNA, 764 bp, Homo sapiens
  misc_feature: GYAE6OF01B5WH9.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcgaggtgcagcgtgggtggaggtcggtggggggaggcggtggtccaggccgtggggacggtccctgacgacctcgtccgtgtgctacgtcctcgtaggtctttccaccttcaagttacctatgcttagtcgacctaccggtggggtccccacgacgggtcctacccggagggtccggagggggtcgtaggggacgggttggggtaggacgttaattacgtaactcaacgtagtacggtaataacgggtaaacttaagtacgggacgtacttagaccggtacccgtaacggttccggtaagggaacgggtcccgtactaccgacctacgtaccgtaccgaagaacgtaactaaacgtaaccgaaaccgtaaaccgaccgtaaacgtaacgttacgttaccgttaacgaaaccgtaaacgttacggaaaccgtaccggtaacccgtaaggaacggttacgacggtacggaaccgggaccgtacgggttacttaggttaaccgttaggttacggtagggtaaggggtagtaaggtacggtagggaggttaacgttaggttaaggttgggtttaagggg

SEQ ID NO: 272280 - DNA, 714 bp, Homo sapiens
  misc_feature: GYAE6OF01CNIW2.14.25.C03.1.454.CMB.1.raw
  modified_base (214)..(214): a, c, t, g, unknown or other
  misc_feature (214)..(214): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (562)..(562): a, c, t, g, unknown or other
  misc_feature (562)..(562): n is a, c, g, or t
  modified_base (582)..(582): a, c, t, g, unknown or other
  misc_feature (582)..(582): n is a, c, g, or t
  modified_base (677)..(677): a, c, t, g, unknown or other
  misc_feature (677)..(677): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggtttcgcgtagctctttaagaggtgtcagtgtcaggtgctgcgtgggtggagtcggtgggggnggtcgtggtccagccgtggggcgtcctgagctctccgtgtgactcgccttcgtaggtacttcctaccgttcaacgttaccgtattcggcttagccggtaacgtcgggttcggacccgaccggcggtccgaccggaggggaccggnggggtcgtaggggnggttacggggtgggacgtaattactacgaccaagtagtacgtaagtaacgggtaaaccttaaagtcggtacgtactacggttaccggacccggtaaccggtttccggaaaggggtaccgggtacccgtaacttccgaacctaccgttaccacgaaacgaacgtaactaaccgttaacgaacaaaccggntaaccgtagtacttaaccgngaaccgttaaagcgaacgacgccgtagacggtacaggtcgaacggtccgacggttccgtagttacgttacgtagggttacggtgggaagtacggngggtaacggtggttaacgtgttagggtggttacgggg

SEQ ID NO: 272281 - DNA, 683 bp, Homo sapiens
  misc_feature: GYAE6OF01CL2KV.14.25.C03.1.454.CMB.1.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (460)..(460): a, c, t, g, unknown or other
  misc_feature (460)..(460): n is a, c, g, or t
  modified_base (556)..(556): a, c, t, g, unknown or other
  misc_feature (556)..(556): n is a, c, g, or t
  modified_base (564)..(564): a, c, t, g, unknown or other
  misc_feature (564)..(564): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaacgaggttcgtccagtgtacgagggtgcaggcgtggggtggaggttcggtaggggggagccggtgggtaccagccgtggggacgtcccgtgacgtaccttctccgttgtcgcgacgtccttcgtaggtacttacctacctttcaacgttacctgtcgacttacgtcggacctacggtcgggtcccncggacggtcnccggagggccgaagggctgggacgtgggtcgacgtaattacgacttcaactgttacggaagtttaacgggaactaaggtacggaaccgtntacgcgaccgacgttcggagaacgggcctaacgtccactactccgtacaagacgaactaacgtaccaacgactacgactagtactcgagaaccaanacggtaanacggtactgacgtacgacgtaggacgaacgtcggtacgtaggttaccgttacggttagtacggggtagggtacgtaaggtacggttacggtaacgttcgtacgttggttggtaacgggg

SEQ ID NO: 272282 - DNA, 538 bp, Homo sapiens
  misc_feature: GYAE6OF01AEQDO.14.25.C03.1.454.CMB.1.raw
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
  modified_base (444)..(444): a, c, t, g, unknown or other
  misc_feature (444)..(444): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggtttcgcgtagctctttaagaggtgtccagtgtcaggtgcagctggtggagtcgtgggggaggcgtggtccagcctgggaggtccctgagactctcctgtgcagcctctggattcacctttcagtacctatgctatgcacgtgggtcccnccaggctccgaggcggaggggctggagtgggtgcgattanatcacatgatggaactaatagacgctatcggcccgacgtccgtaggaacgggccgattcacctactctaccagacgacaacttaccaagaacacgcatactcngacaaatgaacacgccgtagagagctaggacggacacggtctgtagtattagtggtgggagtaggtagtagggaggtacgattagttggtaggg

SEQ ID NO: 272283 - DNA, 695 bp, Homo sapiens
  misc_feature: GYAE6OF01AWV1J.14.25.C03.1.454.CMB.1.raw
  modified_base (318)..(318): a, c, t, g, unknown or other
  misc_feature (318)..(318): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccaggccgtggggacggtccctgacgactctcctgtgcagcctcgtggacttcgaccttcagtacctagtcgctatgcctacgtcggggtcccnccgaggtcctccggagggccgggacgggggcccggtaggtcggggtcggacggtaatttatacgtccagtagtcgtaagtagggaaactaagtacgacgtactagtcggacccgacgttccggtaggaacgggtcctagtccaacgtactcctacgaagacgaactaacttaccgaaacgtaaccacgtactaagtaactcgtacgtaacaaagtacgaaaccgacggtacccgtaggaacggacgtaccggtagggacggaaccgacggtcgttaggtacggtttacgttacgggtgggtaacggggtaaggacggttagggttacggggtaaggttaccggtaaaggtttacggtttagggtagggtttacgggg

SEQ ID NO: 272284 - DNA, 654 bp, Homo sapiens
  misc_feature: GYAE6OF01BQ2MF.14.25.C03.1.454.CMB.1.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcctctggacttcaccttcagtacctatgctatgcacgtggtccncaggcctcgaggcggagggctgggagtgggtgcgtattanatcacatgaatggaaactagtacgacgctaagtcgaccgtacgttccggtaggaacgggtccgtacttccgaacctaagtccctaccgaagaacgtaacctaaacgttaccgaaacgaaccaacggtaccaaggttaactaccttaggaactaaagtacgaaacacggtacccgtaaggaacgtacgaccgttacgggaacggtaaccgaccgggttcgtagggttacgttaacgtttaacggtaggggtaagggtagtaagggtacggttaggggtacggttaagtaagtttaggtttagggttaagggg

SEQ ID NO: 272285 - DNA, 877 bp, Homo sapiens
  misc_feature: GYAE6OF01BWCJA.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgttgggttttcctcgttgcttcttttaagaggtgtcctagtgtcgaggtgcagcgtgggtggagtcggtggggggacggcgtcggtccgaggccgtggggtacggtccccgtaggacgtacctccgttccgttggtcgaccgacgtcccgttgtacgggtactttacccgtaccctttacgaaccggttaccttaagttcggtcttaacgtcgtaccgtaccggtaccggggttcccgccgaacggtcccgttaccgggaacggggccggggacggggtacggtggggtacgggtggggtacggtacggttaatttactacgtacctaacgtagttagtaaggtaaacggtaaacgttaaaggtaccggtaacggtaccgttaacggtccgggtaaccccgtaccggtttaccgggaacgggtaacgggtacccgttaccgtacccgtaaccgtaccgttacccgtaaccgaacgtaaacgtaaccgttaaacgtaaacccgtaaacgaaccgtaaccgtaacgtaacgttacggtacgtaacgtaaactaaacgtaacgaaccggttaccgacggtacgaacggacgtacgggacgaaacggtaccggtacgttaggttacggtttaacgtacgggtttaccggtaaggggttcggaaacgggttaggaagggttaccgggggtttaagttaacgggttaaggtttagggttaagggtttaaaggggg

SEQ ID NO: 272286 - DNA, 746 bp, Homo sapiens
  misc_feature: GYAE6OF01CB7HR.14.25.C03.1.454.CMB.1.raw
  modified_base (189)..(189): a, c, t, g, unknown or other
  misc_feature (189)..(189): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (516)..(516): a, c, t, g, unknown or other
  misc_feature (516)..(516): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatgggagtttgggctgagtcgttcgggttttcctcggttgtcttacgtttttaaaggngggttcgttccgagttcggtcgaggggttcgcaggtcggttggggtacgggtaggttcgggtggggggaggccggtggtacccgaggtccggtagggggacgttccaggaacgtccttcgtcctggacgccgacgtccttgagttaccttcctaaccctttacgacgttacctagngtactancggtccgtacggttcgggccccaccggacggtccctacggacggggccggaagggggcgttggggtacggggtcgggtacgggacttaattaacggtctaacgactaaggttacgaaggtaacggaaatttaacgacggacttntaaccggtcgtaaccgtcgtacgggaggaaccggtctacgtaccacgactacgacgaagtacgtaactaacgtaacgaacgaacgtacgacgtaacgtactacgtacgaaacgtaaacgtacgaaccgacggtacgtacgaggacgacgtacggacggtacgacgttcgtagtacgttagtaggtggtaggaacgtagtggtacggtagtacgtagttggtaggttaggg

SEQ ID NO: 272287 - DNA, 677 bp, Homo sapiens
  misc_feature: GYAE6OF01CHP1W.14.25.C03.1.454.CMB.1.raw
  modified_base (293)..(293): a, c, t, g, unknown or other
  misc_feature (293)..(293): n is a, c, g, or t
  modified_base (391)..(391): a, c, t, g, unknown or other
  misc_feature (391)..(391): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagccgtggggaggtccctgagctctcctgtgcagcctctggacttcaccttcacgtacctatgctangcacgtgggtcccgcgaggcctccagggtcggaggggtctgggaggtggggtggacgtattatagtcaacgtatggatagggaaactaagtaggaccnttagcgacccgtacgtccggaggaacgggcccgtacgttaccacctaatcccgtaccgaacggaacgtaacctaaacttacccgaaacggtaaaccaaccggactaagttactacgtagaacctaaagtacgaaaccacggtacccgtaggaaggtacacggtacggaacgggtaccgaccgggtacgttagggtacgtttaacggtttacggtaggggttacgggaaggtaaggtagggttacgggtaacgggttacggtaactttaggtttggggttaaagggg

SEQ ID NO: 272288 - DNA, 440 bp, Homo sapiens
  misc_feature: GYAE6OF01EY6CP.14.25.C03.1.454.CMB.1.raw
  modified_base (427)..(427): a, c, t, g, unknown or other
  misc_feature (427)..(427): n is a, c, g, or t
  modified_base (432)..(440): a, c, t, g, unknown or other
  misc_feature (432)..(440): n is a, c, g, or t
tcagcgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcatattgtagtggtggtagctgctataactggatcgaccctggggccagggaaccctggtcaccgtctcctcagcctccaccaagggcccatccggtccttccccctggccaccctcctccaagacgccacctcgtgggggcacgacgcggcccgtgggctgcctggtcaaggactacttccgtactagacgctgagcgggctggcaaggcgnatagnnnnnnnnn

SEQ ID NO: 272289 - DNA, 928 bp, Homo sapiens
  misc_feature: GYAE6OF01ERN3P.14.25.C03.1.454.CMB.1.raw
  modified_base (178)..(178): a, c, t, g, unknown or other
  misc_feature (178)..(178): n is a, c, g, or t
  modified_base (361)..(361): a, c, t, g, unknown or other
  misc_feature (361)..(361): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagtcgttgggttttcctcgttgcttacttttaaagnggtgtccgagtgtcgaggtgcagtcgtgggtggagtcggtgggggagcggtggtccaggccgtggggacgtccctggacgtaccttccgtccgtgtcgcctacggtccttcgtaggtacttccgtaaccctttcgaacgttaccttagtcgtacttagtcgaccgtacggtcggggtaccccncgtacggccgtaccggaggccgggaggggtcgtggggtaggttcggggtcggtactaagtttatacgtaccgaacgtagtacggtaagtaacgggtaaactaagtacgtaaccggtacttaaggtccccgacccggttaacctcggggtaaccggaacgggttaccctacgtacccgtaacctacgttaacccgtaccgtaaaggtaaccgtaaaaccgtaaacccgttaaacccgaaaaccggttaaaccccgaaccggtacgtttaaacccgtttaacggtaccggttaactaaaaccggtaaaaccgtaacggaaaaacccgttaccggaccccgggtaaagtaaccgggttaaccgggtcggttaaaccggggaaacggggtaaacccgggttaacccggtttaccgggtttaaacggttttaaccggggtttaaacggttttaaccgggggttagggggtaaaaggggtaaccgggttaaagggtaacggggtttaaacggggttaacggggtttaaaccggtttaagggttttaagggtttaagggggtttaaccgggggg

SEQ ID NO: 272290 - DNA, 711 bp, Homo sapiens
  misc_feature: GYAE6OF01BBXRB.14.25.C03.1.454.CMB.1.raw
  modified_base (159)..(159): a, c, t, g, unknown or other
  misc_feature (159)..(159): n is a, c, g, or t
  modified_base (263)..(263): a, c, t, g, unknown or other
  misc_feature (263)..(263): n is a, c, g, or t
  modified_base (348)..(348): a, c, t, g, unknown or other
  misc_feature (348)..(348): n is a, c, g, or t
  modified_base (596)..(596): a, c, t, g, unknown or other
  misc_feature (596)..(596): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagccgtggggagtccctgacgctctcctgtcgcagcctntggacttccaccttcgagtaccctatcgtctatgcacgtcgggtcccgcgaggcctccgacggcggaggggctggacggtggggnggcgtaattagataccgacgacgtagtactagggaaaccttaagtacggaaccgtcgttaagtccgggtacccgtaaccggttcccgggtagggaaacccgggggtcgtaaccgtttacccgaacccttaacgttccccgttaaccgaaacgggtaccgtaaaccgtaaacgtttaccccgaaaacggtaacccgaaccgtaccgtaacggttacctacgttacggaaccctaaaagttcggaaaccncggtaacctggaacgacgtcgtaggaacggaaccgtcggtcgttagttcggttacttacggtaggttacgggagtacgtaggtacgggtaggttacggtagtttagttgggtagg

SEQ ID NO: 272291 - DNA, 732 bp, Homo sapiens
  misc_feature: GYAE6OF01D9HTV.14.25.C03.1.454.CMB.1.raw
  modified_base (240)..(240): a, c, t, g, unknown or other
  misc_feature (240)..(240): n is a, c, g, or t
  modified_base (326)..(326): a, c, t, g, unknown or other
  misc_feature (326)..(326): n is a, c, g, or t
tcagcgtctagtaccacgaccggtgctcgatttagtagtgtagatttgggtttggggggagacgagcccagcactggaagtcgccggtgtttccattcggtgatcagcactgaacacagagactcaccatggagtttgggctgagtcgttgggttttcctcgttgcttacttttaagaggtcgtccagtgtcaggtgcagcgtggtggagtcgtgggggagtcgtggtccagccgtgggngtccctgacgactctcctgtgcagtcctgtacggtattccaccttcgaacgttacctatcgctagtcgacgtcgtcggggtacccnccgaaggtccgtaccggaggggcggtaggggtcgttggggacggttaggggtgacgttaattagtactccgaaatagtacgtagtaaggaaaccttaagtacgacggtactagcgacccgtacgtacgggtacggaacgggttccctaacgttaccgaacccgtacttacccgtaacgaacgaaacgtaaaccgtaacgttaaacccgaaaacgtaacccggaaccgacgtaaacgtttcgaaccgtttacgaaactaaacggtaccgtaaacgtacgtaccgttaagaacggtacgtacggtacggaacggtaacccgaggtccgttaggttaagttacgttacggtgggttaaagggacgtaggttacggtggtaacggttagtaagttttggtagttacgggg

SEQ ID NO: 272292 - DNA, 698 bp, Homo sapiens
  misc_feature: GYAE6OF01DBXIS.14.25.C03.1.454.CMB.1.raw
  modified_base (160)..(160): a, c, t, g, unknown or other
  misc_feature (160)..(160): n is a, c, g, or t
  modified_base (195)..(195): a, c, t, g, unknown or other
  misc_feature (195)..(195): n is a, c, g, or t
  modified_base (322)..(322): a, c, t, g, unknown or other
  misc_feature (322)..(322): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttccncgttgcttcttttaagaggtgtccagtgtcaggtncagcgtggtggagtcgtgggggagcgtggtccaggccgtggggacgtccctgacgactctcctgtcgcagtcctgtggtacttccgacctttcaacgttacctatgctatcgactacgtcgggtccnccgtacggcctccggagggcggacggggtctggggaggttcggggtgaccgtatttaacgactacaacgtgtagagtaacggaaacttaagtacggaccgtctaggtccgacccgtacgttccggaagggtaacgggccctaacgttacccacctacgtcctaacgtaagaacgtaaactaaccgttaccaacgaactaccgactaacgttactcgacgaacgtaaatacgaaccgacgtacccgtagtacggacgtacgtacggaaccggaccgtacgggtcttaggttacggtttacgttacggttaggggacgggtaagtaaggtagggtacgggttaacggttaggttaagtttacgggttgggtaacgggg

SEQ ID NO: 272293 - DNA, 696 bp, Homo sapiens
  misc_feature: GYAE6OF01AZ8CD.14.25.C03.1.454.CMB.1.raw
  modified_base (266)..(266): a, c, t, g, unknown or other
  misc_feature (266)..(266): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacggtccctgagactctcctgtcgcagcctntggattccaccttcagtacctatcgctatgcacgtcgggtcccgccgaggcctccggagggccgggaggggtccgtggggagggttggggtggacgtaatttagtattaccgaactattcggaataggaaacttaaagtacggacgtacttaagtccggacccgtaccgttcccggtagggaaccgggtcccgtacgttaccaaccctacttcctaccgaacgaacgtaaccaaacgttaccgaaacgaaaccaaccgaccgtaacgttacctacgtacgaacctaaaagtacgaaaccgacgtaccgttagggaagacgtaccgtagggacggtaacgtacggtcgttacggttacgttacgtttacggtagggttacgggagggtaggaggttagggtacggttaggttattagggttaggttagggg

SEQ ID NO: 272294 - DNA, 649 bp, Homo sapiens
  misc_feature: GYAE6OF01BB0DU.14.25.C03.1.454.CMB.1.raw
  modified_base (193)..(193): a, c, t, g, unknown or other
  misc_feature (193)..(193): n is a, c, g, or t
  modified_base (330)..(330): a, c, t, g, unknown or other
  misc_feature (330)..(330): n is a, c, g, or t
  modified_base (470)..(470): a, c, t, g, unknown or other
  misc_feature (470)..(470): n is a, c, g, or t
  modified_base (525)..(525): a, c, t, g, unknown or other
  misc_feature (525)..(525): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctctttttaagaggtgtccagtgtcaggtncagcgtggtggagtcgtgggggagcgtggtccaggccgtggggacggtccctggacgactcgtcctgtcgcgacgtcctgtggtacttccacctttcagttaccctagtcgcttagtcgacctagtcggggtccccnccgacgggcctccggagggcggagggggcctggggacggttgggggtcggacgtaagtttactagtccaactagtagaagttacggaaataagtacgaacgtctagtcgccgtacgtcggtaggaacggccgtatccacnctcacagaactaacacttaccaagaaccacgatagtactcagactaagtcgaacncgtacgtaggacgtacgcggtaggaaccgtccggacgttcggtagttaaggttacgttacgggtagggaacgggagtacggtaggttacgggaacgttagtacggttagggttggttaacgggg

SEQ ID NO: 272295 - DNA, 805 bp, Homo sapiens
  misc_feature: GYAE6OF01DA8SP.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagtcttggggttttcctcggttgtcttacgttttaaggagggttgtccaggtgtcagggtgcagcgtgggtggaggtcgtggggggagtcgtggtccagccgtggggacggtccctgagctctcgtgtcgacagtcctgtaggacttcacctttcagttacctagtcgtaccttagtcggacctacggttcggggccccgtaccgacgggtccctaccggaggggaccgggtaggggtccgttaggggtaagggttcgggggtaggtaaccgttaatttacgtaacttaccgaacgtaaggttacggtaaacttacggggaaaaacttaacgttaacgggaaccgtcgtttaacggtcccgggaccccgttaaaccggttcccgggtaagggaaccgggggtaccccttaacgtttacccaaccgtacgttacccctacggaacgtaaaccggtaaactaaaccgttaaccgaaaccggtaaacaccgtacgtaacgtacctacgtaacggaactaaaagtccgaaaaccgtcggacccgtaaggacgacgtacggacggaacgtaaccgtcggtccgttaggttacgttaacgtagggttaggacggggtaacgaaggttacggtacggggtaagtaggtaagttggttcgggttaggg

SEQ ID NO: 272296 - DNA, 672 bp, Homo sapiens
  misc_feature: GYAE6OF01BHB71.14.25.C03.1.454.CMB.1.raw
  modified_base (517)..(517): a, c, t, g, unknown or other
  misc_feature (517)..(517): n is a, c, g, or t
  modified_base (646)..(646): a, c, t, g, unknown or other
  misc_feature (646)..(646): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagcgtggtttccgtcgtgctctttaagagtgcagtgtcgaggtgcagcgtggtgaggtcgtggggagcgtcggtccagccgtgggacgtccctaggactactcctccgtgtgctacgtcctagtggtactccgtaaccttcgaacgttacctgtcgtacctagtccgacgttacggtccggggtaccctaccggacggtcctcggacggggccggaggggtccgtaggggtagggtcgggtcggtacttaacgtataccgtcagtacgtgaacgtaacggaactaagtcgactatacggtaccgacgtacgtcgacggtacgccgttactccgaactctaccgtagacgtaacgaactaactaccgaacgacnccgagtaactcgaacgtagaaacgtaacgtaacgtaacgaccgagttaaggacgtacgaccgttaggaaccgcccgtaaggtcctagtacgttacggttaggcggttaaggacggtgaacggttacggnggtaacctaaggtttgacggttaggg

SEQ ID NO: 272297 - DNA, 892 bp, Homo sapiens
  misc_feature: GYAE6OF01BQ5DY.14.25.C03.1.454.CMB.1.raw
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgacgtcttgggttttcctcgttgcttacgttttaaggaggtgtccagtgtcgaggtgcaggcgtgggtaggtggtcggtgggggagtcgtggtccaggccgtgggacggtcctgacgtaccttcgtccgtggtcgacgacgtccgttcgtggttaaccttccgtaaccgtttacgaaccggtttacccttagttacggtaccttaggtaccggtccgtacccggggttccgggggttaccccgacccggtaacggtccccgttaccgggacgggggtacgggtaaccgggggtcgtagggggtaacggggttggggtaaccggtaacggttaattttaaacggtcgtaacgtaacgttaacggtacggtaaacgttaacggtaaaaaccgttaagtaaacccgggtacgttaaccgttaacggttcccgggaaccggttacccggttaacgggttaaccggggaaacccgggttaccttaaccggtaccaaacccgttacgttaccccgtaaccggtaaagtaaaccggttaaccctaaaaccgttaacccggaaacgtaaaccggaccctaacgtaaccggttataccgtaacgaaacgttaaagtaccgaaaccgtagtacccgtggaacccggtataccggacggtaacgcgacggttcgttaacggtagttccggtaggaggttagggacgttaaggacggttaaccgggtgtaaaacgtttcggttaggttggggttacggg

SEQ ID NO: 272298 - DNA, 866 bp, Homo sapiens
  misc_feature: GYAE6OF01A2LDP.14.25.C03.1.454.CMB.1.raw
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagtcgttgggttttcctcgttgcttcgttttaagaggtcgtccagtgtcgaggtgcagcgtggtggagtcggtgggggaggcggtggtccaggtccgtggggacggtccctggacgtaccttccgtccgtaggtcgaccgtacggtcccgttcgttggtaactttcccgtaacccgtttcgaacgttaccttagtcgtaccttagtcgccgtaccggttcggggccccgcgaacggccttccggaacggggccggtagggggtccgtaggggtagggttcggggtacggaccgttaagtttacgacctacgacgtagttacggtaaacgtaagggtaaacctaacggtacggaaccgttaccttaacggtccggaccccgttacggtacccggtaaaggggtaacccgggtcctaactttaccgacctacgttaccacccgaagtaaccaacttaaacgtaacccgaaaggtaaaccccgacgtacgtaacgtaaccgtttcgaacggtaaacctaaacggtacgaaccgtaacggtaccctaagggacgtaacgggtaccgtagggtaacccgggaaaccggtaccgggttacccggtttagtttaacggggttaactttacgggggtacggggttaagggggtaacggtaaagggttcggggtttaaacgggtacgggggtttaactttaaagggttttagggtttcggggtttaaaggggg

SEQ ID NO: 272299 - DNA, 654 bp, Homo sapiens
  misc_feature: GYAE6OF01E14G7.14.25.C03.1.454.CMB.1.raw
  modified_base (334)..(334): a, c, t, g, unknown or other
  misc_feature (334)..(334): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgttgggtttttcctcgttgcttcttttaaggaggtcgtccagtgtcaggtgcagcgtggtggagtcggtgggggagcggtggtccagccgtggggacgtccctaggacgtactctccgtggtcgcacgtccttcgtaggtacttccacctttcacgtacctatgctagtgcctaggtcgggtcccncgaggcctacggaggccggtaggggctgggtaggttgggtacgacgtattagtactcgaacgtagtacgattagggaaacttagtacggctcgtacgtcgaccgacgttcggacggaacggtccgtataccactactacctcgaacgacgtaactactaccgaacgacgaacgtacgtacgtactctacgacgtaacgtacgaacgacgtccgtagacgacgtacgacggtacgacgtacggtcgttacggttagttacgttaggtagggtacggaggaggtaggtacgggtagtaccggtagttacggttggttacggg

SEQ ID NO: 272300 - DNA, 650 bp, Homo sapiens
  misc_feature: GYAE6OF01CVZ9B.14.25.C03.1.454.CMB.1.raw
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (324)..(324): a, c, t, g, unknown or other
  misc_feature (324)..(324): n is a, c, g, or t
  modified_base (374)..(374): a, c, t, g, unknown or other
  misc_feature (374)..(374): n is a, c, g, or t
tcagcgtctagtaccacgaccggtgctcgatttagtagtgtagatttgggtttgggggggagacgagcccagcactggaagtcgccggtgtttccattcggtgatcagcactgaacacagagactcaccatggagtttgggctgagctgggttttcctcgttgcttcttttaagaggtgtccagtgtcaggtgcagctgggtggagtcgtgggggagcgtggtccagccgtgggacgtccctgacgctctcctgtncagcctcgngtacttccacttcagtacctatgctagtgactacgtcgggtcccgccgacggcctccgngggcggtaggggcctgggaggttgggacggacgttattaagtatccgaanagttacgagttacggaaacttaagtacggacgtctaactcggaccgtaccgtccggtaagggaacggccgtaacttccaaccgtactccgtaccaagacgtaactaactaccgaacgaaccacgtacgtaagtacttacacgaacaagtacgaactaacgcgtagaagacgagtacggaacggaccgacggtgttagttaggttaacgttaggttagggtacgggaagtaggtaggtacgggtaaggttcggttaaagtttggttgggttaagggg

SEQ ID NO: 272301 - DNA, 716 bp, Homo sapiens
  misc_feature: GYAE6OF01DQ8OY.14.25.C03.1.454.CMB.1.raw
  modified_base (162)..(162): a, c, t, g, unknown or other
  misc_feature (162)..(162): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttggggctgagctgggtttttccncgttgctcttttaagaggtgtccagtgtcaggtgcagctgggtggagtcgtggggggagcggtggtccaggcctggggacgtccctgagctctcctgtgcagcctcgtggtacttccaccttnaacgttacctatgctatgccacgtcgggtccncgaggcctccgagggcggaggggctgggaggtgggtcggcgtaagttatataccaagtagtagaagtacgggtaaactaagtacggacgtacttaagtccggtacccgtaacgttcccggggtaaggaaccgggggtaccctaacgtttacccaacccgttaaccgtccgttaacccgaaggtaaacggtaaacctaaacctttaacccggaaaacgtaaaccgaaccggtactaacggtttaactaccgtagaaaccctaaaagtacggaaaaccgtacggtacccgttaggaaacggtacgacggtagggaaccggacgtaccgggtcgtagttaggttacgttacgtggggtagggagaggtaggtgggtaaggtacgtagttagttgggttaggg

SEQ ID NO: 272302 - DNA, 712 bp, Homo sapiens
  misc_feature: GYAE6OF01BGFOS.14.25.C03.1.454.CMB.1.raw
  modified_base (263)..(263): a, c, t, g, unknown or other
  misc_feature (263)..(263): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaaggaggtgtccagtgtcaggtgcagcgtggtggagtcgtgggggagcgtggtccaggccgtggggacggtccctgacgtactctcctgngcagcctctggattccaccttcagtacctatgactagtgcgtacgtgggttccgaccgaggtcctccgaggccggaggggtctgggtaggtggggtgcgtagttatacgtcacgtagtacggaagttacggaaacttagtaacggaacgtcgtaacgtccggaaccccggttaaccggttccgggtaaggaacccggggtcccgtaacgtttacccgaacctacgttacccgtaacgaacgaaacgtaaccgtaaacttaaccgaaacgtaaccgacgaactaagtactacgtaacgaaccgtaaagtaacgaaccgtacgaccgtaggaacgtaggtacgtaggaacggtaccgacggttacgtggttacgttaacgtttgggtagggttacgggaggtaaagtacgggtacgggtagttacggtaagtttaggttagggttacgggg

SEQ ID NO: 272303 - DNA, 606 bp, Homo sapiens
  misc_feature: GYAE6OF01D0Q38.14.25.C03.1.454.CMB.1.raw
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (390)..(390): a, c, t, g, unknown or other
  misc_feature (390)..(390): n is a, c, g, or t
  modified_base (529)..(529): a, c, t, g, unknown or other
  misc_feature (529)..(529): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctcgtggattcacctttcacgtacctatnctancgcacgtgggtcccnccgaggctccgaggccggaggggctgggtaggtgggtggcgattatacgtcaacagtgagtaggaaacttaagtaacggaccncttaagtcgaccggaaccgttccggtaggaacggggccctagttccaaccctatccgtaccgaagtacgaactaacgttaccaacggaaccaacgctaagtacttcgtagacctaaagtcgaaacacggaccctagganagtctaggacggaccgtaggcttaggttagtacgttagtggtaggagtagagtagggacggtagtattgttgtaggg

SEQ ID NO: 272304 - DNA, 609 bp, Homo sapiens
  misc_feature: GYAE6OF01EREXQ.14.25.C03.1.454.CMB.1.raw
tcagcgtctagtaccacgaccggtgctcgatttagtagtgtagatttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctgggagtgggtggcgtattatatcacatgatggaactaatagacgctatgccgactccgtgaagggccattcaccatctccagagacaattccaaagaacacgacagtaatctagacaaaatgaacagcctgagagctgaggacacggctgtgtattactggtgggagagagtgggagtcgtatagttgtaggtggtaggtagtctgtactaagtaacgtggtacgttacccggaccccggtcgggggaccgaaccgggtaacccgttcgggtacctaaccccggttcctcccgtacgtaccggccccttaccccgaacccggtaaacgggtccccctaaaggttcccgggttccccgttccccccgtacccggg

SEQ ID NO: 272305 - DNA, 662 bp, Homo sapiens
  misc_feature: GYAE6OF01D7RM9.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtggggacgtccctgagactctcctgtgcagcctcgtggacttccacctttcagtacctatgctatgcacgtcgggtccgccacgggcctccggagggcggacggggctggggtacggtggggtacggacgtaatttagtactccgaacgtataggtaagtagggtaaaacttaagtagaaccggtctacgtacgacccggtacgttacccgggtagggaaacggggtcccgtagttacccaaccgtacttcctacccgaaagaacgaactaaacttaccgaaacgaaccaccgactagtactctagaacaagtacgaacgtacgaccgtaggacgacggtcgtaggaacggtacgaccgggtgttagtagttacgttacgtgggttcgggaagtggaagtgggtaggtacgttagttaggttgggttaggg

SEQ ID NO: 272306 - DNA, 677 bp, Homo sapiens
  misc_feature: GYAE6OF01AOQOU.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccaggccgtgggagtccctgagactctcctgtgcagcctcgtaggattccacctttcacgtacctatgctagtgcacgtcgggtcccgccgacggcctccgagggcggacgggggtctggggaggtgggttcggcgtaatttagtactcaactatggtaacgtaggaaacttaagtacggaccgacttaacgtcggacccggtaacgttcccggtagggaaacggggcccgtaagttcccaacccgtatccgttaccaaggaacgaacctaaacgttaccaaaggaacctacgactaagttacgtactacgaactaaacgtcgaaaccagaccgtaacggagacgtccgtaagggacgacgtcggtacgttacggttacgtacgttacggtagggtacgggtaggaaggtacggttaggggacggttaggtacgtttaagttggggttaaggg

SEQ ID NO: 272307 - DNA, 696 bp, Homo sapiens
  misc_feature: GYAE6OF01B4DUP.14.25.C03.1.454.CMB.1.raw
  modified_base (332)..(332): a, c, t, g, unknown or other
  misc_feature (332)..(332): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagctgggtggagtcgtggggggagcggtggtccagccgtgggacggtccctggacgacctcgtcctgtgccacgtcctcgtggattccaccctttcaacgttaccctatgtcctagtgacctacgtcgggtcccnccgacgggcctccgagggcggagggggtctgggaggtcggggtaggaccgttaattagtacgtctaacgagttacgagtacgggtaaaacctaagtacggaccgtactaacgtcggacccgtaccgtccgggtaggaacgggtccgtacttaccgaacctctaccgtaccgaacgaacgtaactaacttaacccgaaataaccgacgtactagttacacgtacgaactaacgtacgaacgacggtcctaggaacgacgtcgtacggaacggtcgtacggtcggtgttacggttacgttacgtagggtgggaacggaagggtacggtaacggggacggttaaggtagttagttagggtttacggg

SEQ ID NO: 272308 - DNA, 980 bp, Homo sapiens
  misc_feature: GYAE6OF01A2A0L.14.25.C03.1.454.CMB.1.raw
tcagcgtctagtaccacgaccggtgctcgatttagtagtgtagatttgggtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtacctatgctatgcacgtgggtccgccaggcctccgaggcggaggggctaggaggtggggtaggcgaatttagtaactcgaactagttgaagttacgggtaaaaacttaaagttaacgggaccgtaccttaagtccggtaccccggtaacccgttcccgggtaagggtaaaccgggggtccctaacgtttccaaaccctacgttccctaccgaaaggaacgtaaacgtaaacctttacccgaaaaacgaaaccaaccggtactaacggtttaaccacgttaacgaactaaaaagtacggtaaaacgacggtaccgtaaggtaacgaacgtacgtacgggaaacgaaccgggtaacggtccgttaggtttaacggtttaacgttacgggttagggggttacggggaaaggtaacggtaaacgggttaagggggtacgttaaacggtttaaaggtttaaacgttttagggggtttaaggggttgggtttaaccggggttaaccgtcgggttaccggttttaaacgtttaaaccgtaaaaccgggggtttcgggttaaccgtaccccggggttaaacccccgggttgggggaacccccgttaaaccggggggtaaaccccccggtttggtaaaccccccgtttaccgggttccccgttaaccccgttcccgggaaacccgttacccccgggaaacccccggtaaaccccgggtaaaaccccggggttcccccgttaaaccccgggttttccccggtttaacccccccggttccccccggttaaacccccggg

SEQ ID NO: 272309 - DNA, 746 bp, Homo sapiens
  misc_feature: GYAE6OF01ARUN6.14.25.C03.1.454.CMB.1.raw
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagcttgggttttcctgttgctcttttaagagtgtccagtgtcaggtgcagcgtggtggtagtcgtgggggaggtcgtgggtaccaggccgtggggacggttccctgacgtactccgtccgtggtcgccgaggtcccttcgttgggtaacctttcccgtaacctttcgtaaccggttaacccttagtcggtaccttacgtggacctaacggttccgggggttaccccaccggtacgggtaccccgtccccggtaaagggggccccgggtaaggggggttccccgttaaggggggtaaccggttgggggttccggacgttaagttttaccgacgtactacgtaagtaggtacgttaaggaaacttaggacgtaacgctaagcgacctacgtcggtaagacgggcgacgtacacctactcgtacgtacgaacgtaacgtaactacgaacgaacctaacgactagtactacgactacgaagtacgtaacgacgacgtgaacgcgtaacgacgacgtacgacgtacgacgttacgtgttaccgtggttacgggaaggtacggtaaggttacgggtacggttaccggtaagttgggtttaggtacggg

SEQ ID NO: 272310 - DNA, 620 bp, Homo sapiens
  misc_feature: GYAE6OF01CXRVT.14.25.C03.1.454.CMB.1.raw
  modified_base (158)..(158): a, c, t, g, unknown or other
  misc_feature (158)..(158): n is a, c, g, or t
  modified_base (175)..(175): a, c, t, g, unknown or other
  misc_feature (175)..(175): n is a, c, g, or t
  modified_base (261)..(261): a, c, t, g, unknown or other
  misc_feature (261)..(261): n is a, c, g, or t
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttccncgttgcttcttttaagnggtgtccagtgtcaggtgcagctgggtcggagtcgtgggggagcgtggtccaggcctggggacgtccctgacgactctcctgtgcngcctcgtggacttccactttcgagtacctatgctancgactcgtcgggtccgccaggctccgaggccggaggggctgggagtgggngcgtattanactcaactntaggactagggaaactagtagacgcttaagccgcgacgtccggtagaaccgggtctacgttccaccgtacttcgtacccgaagacgaactaacttaccgaacgaaccacgacgtacgtatccgtagaactaacgtacgaactacggcctaagggacgagacgtaggaacggtacgacgggtctaggtgttaacgttaggtacgggtaggtcggtaagacggttagggtacgttacgtaagttggttacggtaggg

SEQ ID NO: 272311 - DNA, 755 bp, Homo sapiens
  misc_feature: GYAE6OF01BLJ30.14.25.C03.1.454.CMB.1.raw
  modified_base (175)..(175): a, c, t, g, unknown or other
  misc_feature (175)..(175): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagnggtgtccagtgtcaggtgcagctgggtggagtcgtgggggaggcgtggtccagccgtggggacggtccctgacgacttcctccgtgtgcaggtcctgtggattccgaccctttcaacgtacctagtcgctatcggctacggtcgggtcccgcctaggggcctccggagggcgggaggggtcgtggggtaggtggggtcgggacgtaagtttaatacgtcacgtaagtcggtaagtacgggtaaaacttaaggacgacgtacttaacggtccgacccgtaacggttcccggtagggaaccggggtcccgtacgttaccaacccgtactacccgtaccgtaagaacgtaactaaacgttacccaaaacggtaaccaacggacctaacggtaccttacgtacggtaacctaaagtacgaaaccgtacggtacccgttaagggacggtacgtacggttacgggaaccgggtaccggtaaccgggtacgttgggttaacggttacgtttacggggtagggttacgggggaaggtacgtaagggttacggggtaggttaacgtaagtttaggttgggttaaggggg

SEQ ID NO: 272312 - DNA, 899 bp, Homo sapiens
  misc_feature: GYAE6OF01BWXTX.14.25.C03.1.454.CMB.1.raw
  modified_base (177)..(177): a, c, t, g, unknown or other
  misc_feature (177)..(177): n is a, c, g, or t
tcagcgtctagtaccacgaccggtgctcgatttagtagtgtagatttgggtttgggctgagcttgggttttcctcgttgctcttttaagaggtgtccagtgtcaggtgcagctggtgggagtcgtgggggaggcgtggtccagccgtgggaggtccctgagctctctgtgcagcctntggtacttcaccttgagtacctatgctagtcgcgacggtcgggtcccgaccgaggccaccggagggccggaggggtctaggggaggtggggtaggcgtaattatactacactagttgaacgtaggtaaaactaagtacgaccgtacgttaacgtcggacccgtacggttacccgggtaagggaaccggggtacctactttacccgaaccctagttacccaccggaaggaacgtaaacctaaacttaaccccgaaaaggtaaaccacccggtaattaaaccggtatttaccctaaagtaaaaccgtaaagtaccgaaaaccgttcggaccggtaaggaaggaccggttacggtaaccgggaacggtacccggaacggtttcgtttagggtaaaccttttaaggtttacggtagggggaagggttaaagagggtaaccggttaggggtaaccggttaagtagggtttagtttaaggggtgttagggggttacctacgggttacgtaggttaacccgttaaggtaccttaccggggaccgttaccccgggtacccggggtacggggtaaccgtaaccggggtacccctttacgggaaccccttacccgggtttccaccccggttacccgtaacccgaccccccgtttaaccccggggaaacgttacccccgggttcccctaacccgggttttcccccggtcccccgggtttccccctaacccggg

SEQ ID NO: 272313 - DNA, 762 bp, Homo sapiens
  misc_feature: GYAE6OF01C2U17.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtggggacggttccctgagacctctccgtgtcgcacgcctcgtggtactttccacctttcaacgttaccctagtcgtacttatcgacctaccgtcgggggtccccgaccgaacggtccgtacccgaaggggccgggaacggggggtccgttagggggagggttcgggggtacgggtaccggtaattttaacgtacgtaccgaacgtagtacggtaagttaacggggaaaaccttaaagtaggaccgtactaagtccggtacccgtaccgttccggtaggaaccggggtcctaacttcccaacctactcctaccgaagtaacgaactaaaccttaccgaaagaaccacgacacgttactacgtacaactaaacgtacgaacgtacggtaccctaggaacggtacgtaccgtaggaacgggaaacccgtcggggtacttagggttaacgttacgttaacgggttgggtaacggggaagtaaagggtaggtacggggtaaacggttggttaaaacgttggttttagggtaacgggg

SEQ ID NO: 272314 - DNA, 885 bp, Homo sapiens
  misc_feature: GYAE6OF01DSEAM.14.25.C03.1.454.CMB.1.raw
tcagcgtctagtaccacgaccggtgctcgatttagtagtgtagatttggggtttgggggggagacgagcccagcactggaagtcgccggtgtttccattcggtgatcagcactgaacacagaggactcacatggagtttgggctgagtcgttgggttttcctcgttgtcttacgtttttaaggaggtcgtccgagtgtcgaggtgcagtcgtgggtggaggttcggtggggggagtcggtggtccaggcccgtggggacgttccctggacgtactccgtctggtgcacgtcctgtaggtacttccgtaccttagacgttacctatcgcttacgcgcgtacggtccgggtcccgacgacggtcccgtaccggacgggccggggaggggtcggtaggggtcgggttacgggggttggaccgttaattaacttacgtactaacgtagttacggaagttaaaggtaaacgttaaagtacgtaacgtaccgttaacgtcccgggtaacccggttaaccggttaccgggtaacgggtaaacccgggggtcccgtttaacccgttaacccgtaaacccttacgtttaaccccgtaaacccggtaaaggtaaacccgttaaaaccgttaaaccgttaaaacccggtaaacgaaaacccggtaccggttaactaaacgggtttaaccttacgtaacggtaaactaaacgtaagaaacccgtacggtaccgttaaggaacggtacgttacgggacggtaaccggaacgtacgggttactttaggttaaccggtttaaggttacgggttaggggtaacgggtaaagggtacgggttaagggggttacgggggggtaacggggtttaggtaacggttaccggttaacgggttaaggg

SEQ ID NO: 272315 - DNA, 740 bp, Homo sapiens
  misc_feature: GYAE6OF01CSLZ5.14.25.C03.1.454.CMB.1.raw
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagcttgggttttcctcgttgcttattttaaggaggtgtccagtgtcaggtgcagcgtgggtggaggtcggtggggggaggtcgtgggtccaggccgtaggggacgtccctgacgtacttctccgtggtcgcacgtccttcgtaggtactttccgacctttcaacgttacctatgtacctatcgacctaccggttccggggtccaccggacgtccgtccgaggggccggtagggggtcgtaggggtacggttgggggtcgacgttattagtactcgatagtacgaagttacggaaacttaagtacggacgtacttaacggtccggtacccgtaccggttaccgggtaacggggtaaccgggtaccgttaaccttcccgaacctacgttacccgtaccgaaaggtaacgtaaacgtaaaccttaccgaaactaaccgacgtactaagttcctacgtacgaataaacgtcgtaaacgcgtactacggaagtccgaagtccggaacgggtaccgtggtcgttacggttaacgttacggttgggtagggtagggtacgaggtggttacggtacggttagtagttggttgggttacgggg

SEQ ID NO: 272316 - DNA, 694 bp, Homo sapiens
  misc_feature: GYAE6OF01CJFRL.14.25.C03.1.454.CMB.1.raw
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (333)..(333): a, c, t, g, unknown or other
  misc_feature (333)..(333): n is a, c, g, or t
  modified_base (528)..(528): a, c, t, g, unknown or other
  misc_feature (528)..(528): n is a, c, g, or t
tcagcgtctagtaccacgaccggtgctcgatttagtagtgtagatttgggtttgggggggagacgagcccagcactggaagtcgccggtgtttccattcggtgatcagcactgaacacagagactcaccatggagttgggctgagtcttgggttttcctgttgcttctttaagaggtntccagtntcaggtgcagcgtggtggagtcgtgggggagtcgtggccagccgtgggacgtcctgacgtctcctccgtgtacgcacgcctacgtggtacttcccaccgtttacgaacgttacctaagtcgtactagtcgacgaccgtcggggccccncgacggtcctaccggacggggacggagggggtcttaggggaggtcggggtacggacttagttactatcaacgtgtagagtaacggtaaactagacgtacgtacgtacgaccgtcccgaagttacccggaggtaaccggaccgtaacttaccaacgtcctactaccgaaagtacgtaacctaaaccgtaccgaaanaacgtcgaactacgtactactacgaactaagtacaaactccggtaacgaggtagacgtacgacggaacgaccgtacgggtactttgggtaacgttaacgttaggtcgggtaggggaaactagggtacggtaggggtacgttaggttagtttaggttccgggtaggg

SEQ ID NO: 272317 - DNA, 730 bp, Homo sapiens
  misc_feature: GYAE6OF01DEEZ3.14.25.C03.1.454.CMB.1.raw
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
  modified_base (328)..(328): a, c, t, g, unknown or other
  misc_feature (328)..(328): n is a, c, g, or t
tcagcgtctagtaccacgaccggtgctcgatttagtagtgtagatttgggtttgggggggagacgagcccagcactggaagtcgccggtgtttccattcggtgatcagcactgaacacagagactcaccatgggagtttgggctgagtcgttgggttttcctcggttgcttacgttttaaaggnggttcgtccaaggttgtaccgagggtnccaggtcgtgggtaggagttcgggtaggggaggcgtcggtccaggccgtggggtacgtccctgaactcgtcctcgtgtcgactacgtgtaggtactcgagtcttagtagtagttacncggctaacgtgtaccgtacggtcgggacccgaccggacgtccgacggacggaacggtagggccggtaggtacggttgggacgtcggtagtggtgtacgtagacggaagtaaagtagtaggaaagtcgcggaccggtacgacggtacggaacggtacctacgttaccaacgtactacgcgaagtaacgacctaataaccaacgtaacgttagttcgttactagtacgtaagtaacgtaaagtagtaactacggtactaacgggacgtacgggaaccgtaaggtacgtacggtttcggtaacgtttacgtaagtttcggtacgtaggtaacgtaagggagggttcggggtaaggggtcgggttagtaacgtttacggagggttaagttcggttagttaacgggg

SEQ ID NO: 272318 - DNA, 760 bp, Homo sapiens
  misc_feature: GYAE6OF01BR556.14.25.C03.1.454.CMB.1.raw
  modified_base (208)..(208): a, c, t, g, unknown or other
  misc_feature (208)..(208): n is a, c, g, or t
  modified_base (464)..(464): a, c, t, g, unknown or other
  misc_feature (464)..(464): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatgggagtttgggctgagcttgggttttcctcgttgcttcttttaagaggtgtccagtgtcaggtgcagctgggtggnggtcgtgggggaggcggtggtccagccgtggggacgtccctgacgtccttctccgtggtcgcacgtcctcgtggactttccaccctttcaacgttaccctagtgtaccttatcggacctacggtcggggtccccgtccgagggtccctccggaacggggtcgggtaggggcgttggggtacggtcgggggtgtaccgttaattaagttacgtcaactagttgaacgttacgggaaaccttaagtaacggtaccgtntacggtccggccgtaaccgttcggacggtaacgggcccgtagtacctacctaacgtaccgtaccgaacgtaacgtaaccgttaaacgttaacccgaaacgaacccgtaacgaaccgtacgtaactactacgaacgtaaatacgaaccgtacgtaccgtagtaacgacgtacgtaacggaccgggaacgtacgggtaccggttaggttacgtttacgttaacgggttaggggtaagggtaggtaacgtacgggtagggtacgggttaacgttaggttaacggttagggtttaacggg

SEQ ID NO: 272319 - DNA, 680 bp, Homo sapiens
  misc_feature: GYAE6OF01BYZ70.14.25.C03.1.454.CMB.1.raw
  modified_base (369)..(369): a, c, t, g, unknown or other
  misc_feature (369)..(369): n is a, c, g, or t
  modified_base (514)..(514): a, c, t, g, unknown or other
  misc_feature (514)..(514): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtggggacgtccctgagacctctcctgtcgcacgcctgtggtacttccacctttcaacgttacctagtcgcttagtcgcctacggtcggggtcccgccgaggcctccggagggcgggaggggcgtgggagggttggggnggtacgttattaatactccaacgtagtaggagtacggaaaactagtacgacgtctagtccggacccgtacgtccggtagggaaccgggcctacttaccacctactccgtaccaaggaacgtaactaacttaacccgaaagaaccncgtacgtaagtctacgacaactaagtacgaacacgtaccgtagaacgtagacgtaggacggaccgtcgggtcgttagttacggttaacgttacgggttagggtaacggggaggtaaggtaacggtggggtaacggttaggtaagtttagggttagggtttaagggg

SEQ ID NO: 272320 - DNA, 779 bp, Homo sapiens
  misc_feature: GYAE6OF01BHPLJ.14.25.C03.1.454.CMB.1.raw
  modified_base (336)..(336): a, c, t, g, unknown or other
  misc_feature (336)..(336): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagtcgttgggtttttcctcgttgcttacgttttaaggaggtgtccagtgtcaggtgcagcgtgggtggagtcgtggggggagtcgtggtccagccgtggggacgtcccgtgacgtactcctccgtgtgccacgtcctcgtggactttccaccctttcaacgttacctatgctatcgcacggtcgggtcccnccgaggtcctaccgacgggcggaggggtcgtagggtacggtggggtcggacgttagttatactacgatagtacgtaagtaacggaaacttaagtacgacgtacttagcgtacccgtacgtccgggtaggaaccggtccgtacttaccaacctacgtacctaccgaagtaaccgtaacctaaacgttaaccgaaacgaaaccgacgtaacctaacggttactacgtaacggtaaactaaaggttaccgaaaccgtcggtacccggtaagggaaccggtacggttacggtaacgggaaacggtacccgggaacgggttccggttaaggtttacgggtttaaactttacgggttagggggttaacgggaaagggttaaacgggtagggtttaacggggtagggttaaacggttaaggttttaaggggtttagggtttaacgggggg

SEQ ID NO: 272321 - DNA, 781 bp, Homo sapiens
  misc_feature: GYAE6OF01BMPJH.14.25.C03.1.454.CMB.1.raw
tcagcgtctagtaccacgaccggtgctcgatttagtagtgtagatttgggtttggggggagacgagcccagcactggaagtcgccggtgtttccattcggtgatcagcactgaacacagagactcaccatggagtttgggctgagtcgttgggtttttcctcgttgccttactttttaagaggttgtccagttgtcaggtgcagcgtggtggagtcggtgggggaggcgtcggtccagtccgtgggacggtccctgacgacctcgtccgtgtgccacggccctcgtaggtcttcccaccctttcgaacgttaacctagtcgtactagtcgaccgtacggttcggggtacccgccgtacgggcctaccggaggggccggaggggcttggggacgtgggggttacggacgtaagtttagtaacttaccactagtaggtaacgtacgggtaaaactaagtaccggaccgtattacggtaccgtacccccggtaagttccccggggtaaggtaaacccgggggtccgtaacctttaccgaaccctaccgttaccctaaccgtaaacggaaccgtaaactaaacccgttaacccaaacgtaaaccaaccggacctaagtacttacgtacgaacaaacgttacgaaacgtaacgccgtaaggagtaaccggtagacggaccggaaccggtacggttaccgttaggttaaggtttaacgttaccggttagggtgggtaaaggtaggtaacggtgggttaacgggtagtaaggttagtttagggtaggg

SEQ ID NO: 272322 - DNA, 585 bp, Homo sapiens
  misc_feature: GYAE6OF01E2UTM.14.25.C03.1.454.CMB.1.raw
  modified_base (313)..(313): a, c, t, g, unknown or other
  misc_feature (313)..(313): n is a, c, g, or t
  modified_base (356)..(356): a, c, t, g, unknown or other
  misc_feature (356)..(356): n is a, c, g, or t
  modified_base (421)..(421): a, c, t, g, unknown or other
  misc_feature (421)..(421): n is a, c, g, or t
tcagcgtctagtaccacgaccggtgctcgatttagtagtgtagatttgggtttggggggggagacgagcccagcactggaagtcgccggtgtttccattcggtgatcagcactgaacacagaggactcaccatggagtttgggctgagcttgggttttcctcgttgctcttttaagaggtgtccagtgtcaggtgcagctgggtggagtcgtggggggaggcgtggtccagcctggggacggtccctgacgactctcctgtgcagcctctggattccaccttcacgtacctatgctatgctacgtgggtcccncaggctccgagggcggaggggctgggagtggggtgcgtattanatcacatgatggaaactaatagacgctatcgcccgacgtccggtaggaacgggccgtatccaccntcctccagacaactaactaccaagaaccacgctagtactcgtacaacaatacgaacagcctagacgagcgtaggaacggaccgacggtcgttaggtagttacgttacggtagggttacgggagtaaggtagtacggggtaggttagtaattggttggttagggg

SEQ ID NO: 272323 - DNA, 681 bp, Homo sapiens
  misc_feature: GYAE6OF01AE3C7.14.25.C03.1.454.CMB.1.raw
  modified_base (326)..(326): a, c, t, g, unknown or other
  misc_feature (326)..(326): n is a, c, g, or t
  modified_base (516)..(516): a, c, t, g, unknown or other
  misc_feature (516)..(516): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttggctgagcttgggttttccctcgttgcttacttttaagaggtgtccagtgtcaggtgcagtcgtggtggagtcgtgggggaggcgtggtccaggccgtggggacgtccctgacgtactctccgtggtgccacgcctcgtaggtacttccaccttcacgtacctatgcctatcgctacgtcggtcccncgagcctccgaggtcggaggggtctagggacggtgggtcggagttattagtacgtcaacagtggaactgggtaaaactaagagtacccgtagttacgtccggaccgtaccgtcgggttacgaacgggtaccgtaacttacccgaccaacgtccgtacaagtacgaactaacgtaccaacgacctacgtanacgtatcacgaacaagtacgaacgtacgaccgttagaacgtagtacccgtagggaaccggacgtacgggtaccgttgggttaagttaacgtttacggtaggggtacgggaaggtaggtacggttaggggtacggttaggttaattggggtttaggtttaacgggg

SEQ ID NO: 272324 - DNA, 858 bp, Homo sapiens
  misc_feature: GYAE6OF01BMVC1.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagagactcaccatggagtttgggctgagcttgggttttcctcgttgcttcttttaagaggtgtccagtgtcaggtgcagcgtgggtggagtcggtgggggaggtcgtggtccaggtccgtggggacgtccctgacgtaccttctccgtgtcgccgacggtccttcgtaggtactttccgacgtcctttagtaagttagttagtcggtactagtcggtccgtaccggtcggggtccccaccggaccggtcctaccggaagggtcggaacggggtccgtagggtacgggttggggtacgtccgttaagggtttggttaggtacgggttaataacggggtaaacggttaaagtaaagttaaaggtaaacggtacgtaccggaacccggtacggacggttaagggaacccggttccgtaacttaccgaccgttactccgtaacgaagtaacctaacctaaaccgttacccaaaagttacttagttacggtttaactacgtacgtaaacgaaacgtaaagttaacggtaacgtaccggtacggtaacgggaagtacccggggtaaaccggtacggtaacccgggttacgttacggtttagggttaaaccgttttaccggttaaacgggttcggttaaaccggtaggaaacggggtttaaaggggtacggggttaacgggggggttaggggtttaccggtaacgggttaacccgttaccgggtttaaagggtcggtttaaacgggg

SEQ ID NO: 272325 - DNA, 836 bp, Homo sapiens
  misc_feature: GYAE6OF01D1DTJ.14.25.C03.1.454.CMB.1.raw
  modified_base (695)..(695): a, c, t, g, unknown or other
  misc_feature (695)..(695): n is a, c, g, or t
  modified_base (777)..(777): a, c, t, g, unknown or other
  misc_feature (777)..(777): n is a, c, g, or t
tcagcgtctagtaccacgaccggtgctcgatttagtagtgtagatttgggtttgggggggagacgagcccagcactggaagtcgccggttgtttccattcggtgatcagcactgaacacagagactcaccatggagtttgggctgagtcgttgggtttttccctacggttgcttactttttaaggacggttgtcctaaggttgtacgaaggggtgcgaggcggttggggtgggtacggttccggtgggggggaggtccggttggtccccgaaggtccggttgggggaccggttcccgttagggaactaccgttccgtccgttgggtcaaccgtacggtcccttaggtcggtactttacctaaccgttctaacgttaccctagtcgtctagcgtcgtaccggtccgggtccccgacggacggccctacgggaggggccgggtaggggtcgtaggggagggttcgggggtacggtacggttaattacgtacaccggtaataggtacgtaagtaaacggtaaacttaagtaccggactacgttaacgtccggtacccgtcgttacccgggtaggtaaccgggtccttaacgtacctaacccgttataccccgagtaaacgtagtaaaccctaaacttaccgaaaccggaaccctaacggactttaagttaaccgtctaaggaccttaaagaccgtaancccgggtactagggaacgtacggtaggtacgacgggaactaccggtacgttgttacgggtacgttacgggtggtaaaggggngtaaagggtagggtaccggggttaacggttagtaaacgggtttggttgggttaaagggg

SEQ ID NO: 272326 - DNA, 801 bp, Homo sapiens
  misc_feature: GYAE6OF01C7Z9M.14.25.C03.1.454.CMB.1.raw
  modified_base (195)..(195): a, c, t, g, unknown or other
  misc_feature (195)..(195): n is a, c, g, or t
tcagcgtctagtaccacgaccggtgctcgatttagtagtgtagatttgggtttgggggggagacgagcccagcactggaagtcgccggtgtttccattcggtgatcagcactgaacacagagactcaccatggagtttgggctgagcttgggttttcctcgttgcttcttttaagaggtgtccagtgtcgaggtncagctgggtggagtcgtgggggagcgtcggtccagccgtggggacgtccctgacgtcctcgtcctgtcgcacgtcctgtggtacttcctaccttcgaacgttaccctatcgtaccgttaagtcggtccctacggttccggggtccccgtacccgtaacggcccgttacccgggaacggggaccggggtaacgggggtccggttaaggggtaacggggtttcggggttacgggaccggttaatttaacgtaaccgtcctaaacgtacgttaggaaacggttaacggaaaacttaacggtaacgaccggtacttaacggtaccgcccggtaaacggtccggtaacggaacggggtaccctacgtaccctacctacgtcctaccgaagtaacaaccgtaaccgttaaccgaaaacgtaacccacggaacctacggttaactactaacgtaaactaaacgtaacgtaccaaccggtaccgtaggtaagaccggcgttaacgggaccggaacgtcgggtactttacggtaaggttaacgttacggtagggtagggaaggtacgtagggtaacggtacgggttaacgtaagtttcggggtaggtttaagggg

SEQ ID NO: 272327 - DNA, 757 bp, Homo sapiens
  misc_feature: GYAE6OF01DZOIF.14.25.C03.1.454.CMB.1.raw
tcagcgtctagtaccacgaccggtgctcgatttagtagtgtagatttgggtttggggagacaagcccagcactggaagtcgccggtgtttccattcggtgatcagcactgaacacagagactcaccatggagtttgggctgagcttgggtttttcctcgttgcttcgtttttaagaggtgtccagtgtcaggtgcagcgtggtggagtcggtgggggagtcgtggtccagtccgtggggacgtccctgacgaccttctccgtgtcgcacgcctcgtgtactttccaccttcgaacgttacctagttcgcttagtcgacctacggttccgggtcccgccgacggtcctccggagggtcggacggggcgtgggtagggtcgggtggtacgtattaagtacgtcaatagtaggaagttacgggaaacttaagacggtacgtacgttacgtccgcccgtaacgttccgggtaggaaccgggtcctacgtttacccaacctactaccgtacccgaagtaaccgtaaaccttaaccgttaaccgaaacggtaaccctaacgtaacgtaacggtttacctcgtacggtaaaccgtaagtaaccgaaacgtcgtaccgtaagggaacggtactaacggtagggaaccgtacggacggttcggttagttcggtttaaacgttacgggtagggtagggtaaacggtaggttaacgggttacggggtaagtttacggttaaacggtttgggtttaggggttaacgggg

SEQ ID NO: 272328 - DNA, 888 bp, Homo sapiens
  misc_feature: GYAE6OF01D4BDE.14.25.C03.1.454.CMB.1.raw
  modified_base (233)..(233): a, c, t, g, unknown or other
  misc_feature (233)..(233): n is a, c, g, or t
tcagcgtctagtaccacgaccggtgctcgatttagtagtgtagatttgggtttgggggggagacgagcccagcactggaagtcgccggtgtttccattcggtgatcagcactgaacacagacgactcaccatggtagtttgggctgagtcgttcgggttttcctcgttgtcctttacgttttaaggaggttcgtaccagttgtacgaggtcgcagtcgtgggtggaggtcggngggggacgtcgtcggtaccacggtccgtggggaccgttccctagtaccgtaccttcctccgtggtcgaccgacgtccctcgttaggttaccttccctacttaccgtaacgttacctagtactacgtagtcgaccgtccggtccgggtcccacggacggtccgtaccggaggggaccgggtagggtacggttggggtaggggttacgggtacgtaaccgtttaagttaaccttacgtaccgtaacgtagttaggaaacgttaacgtaaaacgtggtaaccgaacggtacgtagtaccccgggtacccgtttaaccgggacggttaaacgggaccccggttaccctaacgttacccaaacccctccgttaccaaaccgtaagtaacccgtaaacctacccggtaaaccgaaaccgaaccgttacctaaccggttaacgttaccgtacgtaacgaaacctaacgtaaccgtaaccgtaccggtaacgggttaacggaaccggtacgtaaccgggtaggaaccccgggtacggtttcggtaaaccgtttaccgggttaagtttttaaccggtaggggtacgggttagggaaaccggtaggttaacggggttacggtaaacggttagtttaacgggttttggggtaagttaaccgggggg

SEQ ID NO: 272329 - DNA, 733 bp, Homo sapiens
  misc_feature: GYAE6OF01B8W2Z.14.25.C03.1.454.CMB.1.raw
  modified_base (285)..(285): a, c, t, g, unknown or other
  misc_feature (285)..(285): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtacctatgcttangcacgtgggtccgcaggctccgaggcgaggggctgggagtgggtggcgtattatagtcacgattgatgggaaacttaagtacgacgtctaagtcggacccgtacgttcccggtagggaaacggggtcccgtaagttccaacccgtactccgttacccaaggtaaccgtaacctaaacgtttaccccgaaagtaaaaccgaccgacctaagtttaactaccgttaggaacccaaaagttacgaaacccaacggtacccgttaagggaacgggtaaacgtcccggttagggaaacgggtaacccggtaacccggggtacgtttacggggttaaacggttttaacgtttaacccgggtaggggttaacgggggtaaacggtaagggttacgggttagggggtaagggtttaccgggtaaagttttaagggttttcggggtttaaagggggg

SEQ ID NO: 272330 - DNA, 877 bp, Homo sapiens
  misc_feature: GYAE6OF01CEXZ1.14.25.C03.1.454.CMB.1.raw
tcagcgtctagtaccacgaccggtgctcgatttagtagtgtagatttgggttgggggggagacgagcccagcactggaagtcgccggtgtttccagttcggtgatcagcactgaacacagaggactcaccagtggagttgggctgagtcgttgggttttcctcgttgtctttacgttttaaggacggtcgtccaaggttcgtcgagggtcgcgtaggtcgtgggtcgggaggtcggtagggggacggtcggtcggtccaggtccggtggggaccggttcccgtaggacgtaccttccgtccgtgtacgcgacgtccgttcgtaggtaccttccgaacctttcgaacgttacctagttcgactagtcgaccgtaacgggtccggggttacccaccggtaggtccctaccggacggggccggggtaagggtccggttaagggtcggggtttaggggacgggtacttaatttaacgaccgttacgaaccgttaggtaacgtaaacgtaaacgggtaaaaccttaaggtaccggaaccgtacgttacggacccgtaccgggtaccggttacgggaaacgggtaaccgggtcccttaaccgtaccgtaaccgtaacgtttaccaacccggtaaaggtaaacctaaaccgtaaaccgttaaacccgaaacggtaaacccgtaacggaacctttaaagttaccctacgaaacggtaaaacctaaggtaacccgtaacggtaaccgacggtaagaccgggtaaacgtcgggtaacggaccggtaacggttccttaaggttgttaaacgtaacggttaggtacgggggaagtaaaccgaggtacgggttaggaaagttgtaaacggtttggtaacgggggttaagg

SEQ ID NO: 272331 - DNA, 910 bp, Homo sapiens
  misc_feature: GYAE6OF01DYGIQ.14.25.C03.1.454.CMB.1.raw
  modified_base (689)..(689): a, c, t, g, unknown or other
  misc_feature (689)..(689): n is a, c, g, or t
tcagcgtctagtaccacgaccggtgctcgatttagtagtgtagatttgggtttgggggggagacgagcccagcactggaagtcgccggtgtttcctttcggtgatcagtactgaacacagaggactcaccatggagtttgggctgagctgggttttcctgttgctcttttaagaggtgtccagtgtcaggtgcagctgggtggagtcggtgggggaggcggtggtccaggccgtggggacggtccctaggacgtaccttctcccgtgtcgccacgtcctcgtgtacttcctaccctttcgaacgttaccttatcggaacctttagtaggcctaccggttcggggtcccccgaccgtacgggtaccccgtccgggaaaggggcccggggacgggggggtacctttacggggggtaaggggtttcgggggtaacgggttacccggtaaagtttttaacgtaacggtaccctaacggtaggtttaaggaaccggttttaaaggggaaaaaccttttaacggaaaccggtaccgtaaccggttaacttcccggggaaccccttacccggtttaccggggttaaagggaaccccggggtacctttaagtttaacccccaacccgtaacgttcccttaaccggaacggttaaacccgtaaacgttaaaccgttaaccccgaaaacggtaaacccnccggtaaacgttaaacgtttaccgtaaccgttaaggaaacccgttaaaagttacccggaaacgtaccggtaccgtaagggaaggtaccgtaggaccgggtaaacgggccgtaacgggtttaccgttaggttacggttttaacgtagggttcgggagggtaagggttagacgggttaggtacggttaacgtagttaaggttagggttagggtttaggtcggg

SEQ ID NO: 272332 - DNA, 707 bp, Homo sapiens
  misc_feature: GYAE6OF01B998W.14.25.C03.1.454.CMB.1.raw
  modified_base (576)..(576): a, c, t, g, unknown or other
  misc_feature (576)..(576): n is a, c, g, or t
  modified_base (670)..(670): a, c, t, g, unknown or other
  misc_feature (670)..(670): n is a, c, g, or t
tcagcgtctagtaccacgaccggtgctcgatttagtagtgtagatttggggtttgggggggagacgagcccagcactggaagtcgccggttgtttccattcggtgatcagcactgaacacaggagactcacagtggtagtttgggctgagtcgttggtttttcctggttgtcctttagtttttaaggaggttgtccgtaaggttgtcgagggtcgacaggtcgtgggtacggaggttccgggtggggggacggtcgtcgggtccaggtcccggtagggaccggtccctagacgtctcctcgtagtcgcagccttgtagtacttcctaaccgtctacgtacctagtgtcttagcgcctccggtaggcccgacgcgccgtcggacggcggacgggtcggtgggtagggtcggggtggacgttattaataccgtagagtaagtagtaacgtaggaaacgtttaagagtaaccgtgtaccgttcgacccgtaggttacggaccgggttaacgccgttaactaccaactaccgtacgtaaccgagtaactacgaaactacgaactaacgaccagtacgtanacgttaacaacgaataccgaagcgtaacgtaggactaaggcgtaacggacggaaccacggttatacggtttagtacgttggacggtagggaacngggtaacgtggagtatttaaggtggttacggttaggg

SEQ ID NO: 272333 - DNA, 808 bp, Homo sapiens
  misc_feature: GYAE6OF01BCKH7.14.25.C03.1.454.CMB.1.raw
tcagcgtctagtaccacgaccggtgctcgatttagtagtgtagatttgggtttgggggggagacgagcccagcactggaagtcgccggttgtttccattcggtgatcagcactgaacacagaggactcacagtggagttgggctgagtcgttgggttttcctcgttgtcttacgttttaaggaggttcgtccgtagtcgtacgaggtcgcgagtgtagggtggtacggtcgggtggggggtacgccgggttcggtaccgacggtccggtgggaccggttccctagacgtcctcctcgtggacgactcgtccgttgacgtaccttccaaccgttcgtaaccgtacttgtgtaccgtatcggaaccccgttcggtacccgggtccccaccggtcggacccctacgggacggggccggggtaaggtcggtcgggagggttcggtggtaattaactacgttaccgctagtagtacggtaaacgtaacgaaaaaccttggccgtaagtacgtaaccgccgggtaacccgaccggttacggaaacgggaccggttaccgtaccttaccgccgaacttaccggtaacgaacgaacgttaaccgaacttaaccgaaaccgtaacgtaacgtaacgaacgttaccgtacgtacgtaactaaacggtacgaacccgtaggaccgttgaaacgtacggtacggaagaaccggtcgtaaccgtaggttacgttaacggttacggtacggttaggggtacggaggttaaaggtacgggttaacgggtacgtaaagggttaggtttacgtggggtttagggg

SEQ ID NO: 272334 - DNA, 879 bp, Homo sapiens
  misc_feature: GYAE6OF01BWTNX.14.25.C03.1.454.CMB.1.raw
  modified_base (186)..(186): a, c, t, g, unknown or other
  misc_feature (186)..(186): n is a, c, g, or t
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
tcagcgtctagtaccacgaccggtgctcgatttagtagtgtagatttgggtttgggctgagctgggttttcctcgttgctcttttaagaggtgtccagtgtcaggtgcagctggtggagtctgggggagcgtggtccagcctgggagtccctgagactctcctgtgcagcctctggattcaccttnagtacctatcgctatgcacgtgggtcccncaggcctcgaggcgagggctgggagtgggtggctatttantcgacagtgagttaggaaacttaaagtacgacgtctaactggcccgtaaccgttccggtacggaaacggggacccgtaactttcaacccacttcccgttacccaaggaacgacctaaacgtttacccaaaaggaaaccaccggtccaaaggttacttaccgtaggaaccctaaaagttcgggaaacctacggtcccttaagggaacgtaacgtccggttaggaaaccggggtaaccgtaaccgggtccgtttgggttaaggtttaaccgtttaaccggtttggggttaaaccgggggaggttaaacggggtagttaacgggggtacgggtttaaccggtaaacggttttaagttttagggttaaggggtttaggggtttagggttaaaccggtccgttaggttaaacgttaacgtttaaaccgggttacggttaaccggttcccccggtaacccccgggtttacggggggaaccctaaacccgggggtaaccccgtttaccgggacccgttaaccccggttccttaccccgttaccgacggtccccctttaaacccgacccgggtaaacccgggtaccccttaacccgggttcccggttttccccccgtcccccggttacccgg

SEQ ID NO: 272335 - DNA, 788 bp, Homo sapiens
  misc_feature: GYAE6OF01AJMZF.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtggggggaggcgtggtccagccgtgggacgtccctgagctctcctgtgcagcctgtggattccaccttcacgttacctatgctatcgcacgtcggtccgccgaggcctccgagggccggagggggcgtgggtacgggtcgggtggggaccgtaagtttaacgtacgtacgtaaccagttaggtacgtaagggtaaactaaagttaacggacgtacttaacgtacggacccgtaaccgttccgggacgggtaaccgggtcccggtaactttcccgaaaccctacgttaccccgtacccgtaaagggtaacccgtaaaacgtaaaccctttaaacccggaaaacggtaaacccccgtaacggtaacccgtaaagttaccgtttaacgttaaccggaaacctaaaacgttaaaccggaaacccgtaacggacccggttaacggaaacggtaacgcgggttaaacgggacggtaaaccggtaccgggtaacgttcggttaaggtttaccgttagggtacgggtaaggggaccggtaaggtaggtacggggtacgggtaagttagttaagggttggttacgggg

SEQ ID NO: 272336 - DNA, 864 bp, Homo sapiens
  misc_feature: GYAE6OF01AJ9VY.14.25.C03.1.454.CMB.1.raw
  modified_base (247)..(247): a, c, t, g, unknown or other
  misc_feature (247)..(247): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctggagcttggggtttttcctcgttgcttcttttaagaggtgtccagtgtcaggtgcagctggtggagtcgtgggggagcgtggtccagccgtggggacgtcccngacgactctccgtgtgcacgcctcgtggactttccaacctttcacgttacctagtcgctagtcgccaccggttcggggccccgccgagggtccctccggaaggggcccgggtaaggggggtcccttagggggtaacggggttcggggggttacgggacccggttaaagttttaacgttaccgtacccgtaaacgtacggttaaggtaaacggtttacgggggtaaaaacctttaaaaggtttaacgggaacccgttaccgtttaagggtttcccggaccccggttaaaccggttccccgggttaagggtaaacccgggggtccccgtaacgtttacccgaacccgtaacgtaccccgttaccgaaacggaaccggtaacctaaacccgtttaccgaaaaccgtaacccgtaaaccggtccgtaacgttacgttacgtacggtaacctaaaacgtaacgtaaaccgaccggtaccgtagggtaacggcgggtaacgtacggaacgggtaccgtacgggttacggttaggttacggtttaacgtttacggtaggggtacggggaggtaaggtacgggtacggggtaggttaaccggtagttaggttttagggttagggg

SEQ ID NO: 272337 - DNA, 736 bp, Homo sapiens
  misc_feature: GYAE6OF01AKI2X.14.25.C03.1.454.CMB.1.raw
  modified_base (587)..(587): a, c, t, g, unknown or other
  misc_feature (587)..(587): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctggagcttgggtttttcctcgttgcttacttttaaggaggtgtccagtgtcaggtgcagcgtggtggagtcgtgggggagcgtggtccaggccgtgggacgtccctgacgtacctctccgtggtgccacgtccttgtggtactttccacctttcacgttacctagtcgtactagtcgcctacggtcgggtcccgaccgacggcctcggacgggcgggtaggggtccttggggacgggttggggtcggaccgttaagtttaacgtaccgttacgaacgtagtacggtaagttaacggtaaacttaaaggtacggacgtacgtaacgtccggtaccgtaccggttccggtaagggaccgggtactacgttaccaacctactcctaccgagaacgtaactaacgtaaccgaaacgtaccgacgtacgtaattactactacgaactaaacncgaacgtaccgaccgtaggaacggtacgtacgtacgggaacggtaccggcgttagttacggttacggtttacgttaacgggttggggtaagggaacgtaaggtacgggttaggggacggttaagtaagtttacgggttgggttaacggg

SEQ ID NO: 272338 - DNA, 701 bp, Homo sapiens
  misc_feature: GYAE6OF01CRVRL.14.25.C03.1.454.CMB.1.raw
  modified_base (616)..(616): a, c, t, g, unknown or other
  misc_feature (616)..(616): n is a, c, g, or t
tcagcgtctagtaccacgaccggtgctcgatttagtagtgtagatttggggtttgggggggagacgagcccagcactggaagtcgccggtgtttccattcggtgatcagcactgaacacagagactccacatggagttggctgagcttgggttttcctgttgcttcttttaagaggtgtccagtgtcgaggtgcgagcgtgggtggaggtcggtgggggagcgtggtccagccgtggggacgtccctagacgccttcctccgtgtacgcacgtccttcgtaggtacttcccaccttacgtacgttaacctgtcgctagtcgaccgtacggtcgggtcccgaccgacggccgtcggagggccgggagggtcggtgggtagggtcgggtcgggtacgttattaagtactcgtaacgtagtagtacgttaacggaaacttaaagtacgtacacgttacgcgtacccggaccgttacgggacggtaacgggccgtaactaccgactaccgtctacgaagaactaacaacgtaccgaagaacaccgtagtactacgtcctagaactaaagtcaacgtacggaccgtagaccggtagtccggaggaccggacgtaccgggtntttaggtacggtttaggttaggaggggttagggaacggaggttagggtacggttagtaggttaaggttggtttacggggttgggg

SEQ ID NO: 272339 - DNA, 789 bp, Homo sapiens
  misc_feature: GYAE6OF01D1JMF.14.25.C03.1.454.CMB.1.raw
tcagcgtctagtaccacgaccggtgctcgatttagtagtgtagatttggggtttgggggggagacgagcccagcactggaagtcgccggtgtttccattcggtgatcagcactgaacacagaggactcaccatggagttgggctgagtcttgggttttcctcgttgcttcttttaaggaggtgtccaggtgtcgaggtgcagcgtgggtggacggtcggtggggggaggcggtggtccaggtccgtggggacggtccctgacgtacctccgtccgtggtcgcacgtccctcgtggtacttcccacctttcacgttacctatggctagttcgccacggttcggggtccccgaccggtacgggtccctaccgggaagggggccggggaacggggggtccgttagggggtagggttgggggtacgggtaccgttatttaaactcgtaccaactaggttgtaagttaacggtaaacttaagtacggaacgtcttaacgtccggaccccgtacgtcccgggtaagggaaccgggtccgtacttcccaacctactcctaccgagaacgtaacctaacttaaccgaacgaaccgtacgaccgtacgtactacgtacaacgaagtaacgaaccgaacgtccgggtaaggaacggtacgggtacgtacgggaaccgggtaccggtacggttccggttaggtttaacggttaaccgtttagggtaggggtacggggtaaggtagggtacgggttaggggtaacgggttagttaaaggtttggtttgggtttaacggggg

SEQ ID NO: 272340 - DNA, 714 bp, Homo sapiens
  misc_feature: GYAE6OF01CDOMJ.14.25.C03.1.454.CMB.1.raw
  modified_base (189)..(189): a, c, t, g, unknown or other
  misc_feature (189)..(189): n is a, c, g, or t
  modified_base (313)..(313): a, c, t, g, unknown or other
  misc_feature (313)..(313): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcnggtgcagctggtggagtcgtggggaggcgtggtccagccgtggggacgtccctgacgcttctcctgtgcacgcctgtggacttccaccttcacgttacctatgctatgccacgttcgggtcccnccgtacggcctccgagggccgggaggggcgtgggagggttcggggtaggtacgtatttagatccgaagtagttgagttaacggtaaactagtacggactactacgtcgacccgtaccgtcgggtaacggtaacgggtccgtaacgtccaccctactccgtaccgaagtaacgaacctaacgtaacccgaaagaacccgtaccgaccgtagtaccttacgacgtaactaaacgtacgaacgacggtacccgtaggaacgacggtacgtacgggaacggtaccgtacgggtcgttaaggtttcgttaaacgtttacgggttacggggttagggaaagggtacgggttaagggttaggggtaccgggttaaggtttaaacgtttgggtttaaggggttacgggg

SEQ ID NO: 272341 - DNA, 717 bp, Homo sapiens
  misc_feature: GYAE6OF01AG9IN.14.25.C03.1.454.CMB.1.raw
  modified_base (664)..(664): a, c, t, g, unknown or other
  misc_feature (664)..(664): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggacgtttgggctgagctgggttttcctcgttgcttcttttaagaggtgtccagtgtcaggtgcagcgtgggtggagtcgtgggggagcggtggtccagtccgtgggagtccctgacgtctcgtccgtgtgcacgtcctgtggacttcaccttcacgtacctagtgtctagtcgctacggttcgggtccccgccgtacggtcccgtaccgacgggccgggtacgggggcgtggggtacgggttgggggtaccggtccgtaagtttaacgtacgttccgaacgtaacgtggtaacgttagggaaacccttaagtacggtacggtacttaacgtccgacccgtaccgtccgggtaggaaccgggtaccgtacttaccaaccgtataccccgtacgtacgaaccgaccttaaacgtaccgaagaccgtacggacctacgtactctacgactaaacgtcgaactcgacgtagacgtacgcgtacgacggacgtcggtacgtacgttacgttacgttaggaggggtaaccgggtaanaggggttacggtacggggttacgttaagttcgttaagggtttaggtacggggg

SEQ ID NO: 272342 - DNA, 837 bp, Homo sapiens
  misc_feature: GYAE6OF01BAQEM.14.25.C03.1.454.CMB.1.raw
  modified_base (340)..(340): a, c, t, g, unknown or other
  misc_feature (340)..(340): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagtcttgggttttcctcgttgccttcttttaagaggtgtccagtgtcgaggtgcagcgtggtggagtcgtgggggagtcgtggtccagccgtgggacgtccctgagtactctccgtgtcgcgacgtccgttcgtggtactttccaacccgttgacgttaccttagtcgacttagtcgacctacggtcgggtcccncgaaggtccctacggacggcgggaggggtcgtaggggtacgggttggggtacggtacggttaatttaacgtacgtaccgtaagtaaggttaggtaacgggttaaacggtaaaaccgttaaggtaaaccggtaaccggtacttaaccggtacggtaccccggtaaccgttaccgggttaagggaacccggtacccgtaccgttaccaacccgtacgttaccgtaccgaacgtaaccgaaccttaaacgttaaccgaaacgtaaccgaacgtaaccgtaacgttaacgtacgtaacgtaaacgtaaacgtaacgtaaaccgaccgtacgtaacggtaacggtaacgtacgtaaccgggaacggaaccggttaaccggtaccggttaaggttaaccgtttaaggttaaccgggttaggggttaaagggtaacgggttaacggtagggttaacgggtaaccggttaaggtttaacggtttagggttaacgggttaaggggg

SEQ ID NO: 272343 - DNA, 761 bp, Homo sapiens
  misc_feature: GYAE6OF01C17K7.14.25.C03.1.454.CMB.1.raw
  modified_base (214)..(214): a, c, t, g, unknown or other
  misc_feature (214)..(214): n is a, c, g, or t
tcagcgtctagtaccacgaccggtgctcgatttagtagtgtagatttgggttggggggagacgagcccagcactggaagtcgccggtgtttccagttcggtgatcagcactagaacacaggacgactccaccagtggtagtttggctgagtcgtttggttttcctcgttgtcttacgttttaaggaggtcgtccgagttgtcgtaggtcgacgnggtcgtgggtaggaggttcggtgggggacggtcgtcggtaccgacggtccgtggggacgtcccgtggacgtccttctcgtgtcgcacgtccgtcgtagtcttacctacgttacgtaccgtactgtacgtctacgtcgtccgtacggtcggtcccgacgtacggtcgtaccggaggcggtagggtcgtaggggtacggtgggtacgtataagtttagtaacgtcagtaagtacggaaggttaaacggaacttaaacgacggaccgtagtttccgaccgtaccccggtaccggtaacgggtaacgaacgggtacccgttaccgtaccgtaaccctacgtaccgttaacccgaagttaacccgaacgttaaaccgtaaaccgaaacgtaaccgaacgttactaacgttacgtaacgtacggaaactaacggtacgaacgtacgtaacgtagaacgtagtaccggacggaacgacggtacgtcgttagttacgttaacgtaggtaggaggagtaaggtacgtaggtacgttagtacgttagtcggttaggg

SEQ ID NO: 272344 - DNA, 977 bp, Homo sapiens
  misc_feature: GYAE6OF01EJMP7.14.25.C03.1.454.CMB.1.raw
  modified_base (176)..(176): a, c, t, g, unknown or other
  misc_feature (176)..(176): n is a, c, g, or t
tcagcgtctagtaccacgaccggtgctcgattttagtagtgtagatttgggtttggggggagacgagcccagcactggaagtcgccggtgtttccattcggtgatcagcactgaacacagaggactcaccatggagtttggctgagcttgggttttcctgttgcttcgttttaagnggtgtccagtgtcaggtgcagcgtggtggagttcgtgggggagcggtggtccaggcccgtggggacgttccctggagtaccttccgtccgttgtcgccgtacggtcccctcgttcggtaactttcccgtaacccgtttcaacgttaaccctagttcgacttagttgacctacggttccggggtcccaccgtcggtacccttacccggagggggacccggggtagggggccgttagggggtaccggttggggggtcgaccgttaaagttttaacgtactaacccgaagtaagttagtaacgggttaaacggtaaaaccttaaaacgtacgggtaacccgtaccgtttaagttacccggggacccccgttaaccgttacccggggttaacgggaaaccgggggttacccccgttaacttaaccccgttaaaccccgtacgtttcccccgttaaacccggtaaagggaaaaccgttaaaccgttaaaccctttaaaccccggaaaaccgtaaaacccgaacccgggttaaccgtttaaacgtttaacccggtttacccggtaaacgtaaacccgtaaaaacggttcccggaaaacccggttaacggtcccggttaaacgggaaacgggttaccgtaccggggttaaccgggaaccgtaaccccgggtaaggggttacccgtttacgggtttttaacgttttaacgtttaaccgggttagggggtaacgggtaaagggtaagtacggggtttaaaggggaacccggttaaggtttaaacggttttagttacggggttttaagggg

SEQ ID NO: 272345 - DNA, 973 bp, Homo sapiens
  misc_feature: GYAE6OF01C7H2O.14.25.C03.1.454.CMB.1.raw
tcagcgtctagtaccacgaccggtgctcgatttagtagtgtagatttgggtttggggagacgagcccagcactggaagtcgccggtgtttccattcggtgatcagcactgaacacagagactcacatggtagttggctgagtcttgggtttttcctcgttgctttacgttttaaaggaggttcgtccgtaggtgttcgagggtgcagcgtgggtggagtcggtggggggagtcggtcgggtccaggccggtggggaccggttccctaggacgtacctttcctcccgttaggcgtaccacggttcccttcggttagggttaacctttaccgtacccttttacgaaccgtttaccgtacgttcgtacttacgtcggtaccgtacgggttcccgggggccccgtaaccggtcgggtaccacccggaggggcccggggtaagggggtcggtggggtacggggttggggttccggagtttaagttaacgtactcccgtaaagttacggtagaaaacggtttaaaggtaaactttaaagggtaacggaccgtacgttaacccgtccggtacccgtaccgggtttaaccggggaaacgggtacccgggggtaccccttaccgttaacccgtaacccccgttaaccgttacccctaaccgggaaacggtaaaaccctaaaccgtttaaacccgttaaaacccggaaaacccggtaaacccggtaaccccgttagtaaaaccggttttacctaacgtaccggttaaaactaaacgtaaccggggaaacctacgggtaacggttaaacgggaccgggaacggtttcgggtaaccgggtaaacggggtaaaccggaccccgggtttagtttaccggtttaaggttttaccgttacggttttgggaaacttacggtaaagggggtcggttaaaggggggttagggggggtaacggggtttacgggtcggtaacggttaaacgggg

SEQ ID NO: 272346 - DNA, 982 bp, Homo sapiens
  misc_feature: GYAE6OF01A1O5W.14.25.C03.1.454.CMB.1.raw
  modified_base (353)..(353): a, c, t, g, unknown or other
  misc_feature (353)..(353): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggtagtttgggctgagtcgttcgggtttttcctcgttgtaccttacgtttttaaggaggttcgtccagttgtcgaggtgcagtctgggtggtaggtcggtgggggaggtcggtcggtccgacggtccggtggggacggtccctgacgtaccgttccttccgtagtgccacgtcccgttagtacgggtacttaccgtaccctttacaacgttaccttagtcncgttaagtcgaccgtacggttcccggggtcccgacccgtacggtccgtacccggtaaggggccggggacggggtcgttaggggacgggttcggggtcggtacgttaaacgtttaagtaccttccgaaacgttagtaggtaacgttaaaggtaaaacgttacgtaaccggtaaccgttacgtacggtacccggtacccggttaaccgtcccgggtaaggggaacccgggttacccgttaactttacccaaacccgtttacgtacccgtaccggtaaacgaaccgtaaaacgtaaaccgttaaaccccggaaaacgaaccgtaaccccggtaacttaaccgggtttaacctaccggttaacggtaaaccgtaaaacggtacccgtaaaaaccggttacccgtaacccggtaacggtaaaccgggtaccgggttaacggtaacccggggtaaaccgggttaacccgttaacgggtacccgggttttaacggggtttaagttttaaaccccggtttaaggggtccggggttaaaaggggttaagggttaaacgggtaacggggtttaacgggttaaacccggttttaaaggggttaaacgtttttaagggggtttaacggggtttaacggggg

SEQ ID NO: 272347 - DNA, 707 bp, Homo sapiens
  misc_feature: GYAE6OF01AVU2D.14.25.C03.1.454.CMB.1.raw
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (276)..(276): a, c, t, g, unknown or other
  misc_feature (276)..(276): n is a, c, g, or t
  modified_base (339)..(339): a, c, t, g, unknown or other
  misc_feature (339)..(339): n is a, c, g, or t
  modified_base (640)..(640): a, c, t, g, unknown or other
  misc_feature (640)..(640): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggacctcaccatgggagttttgggctggagtcttgggtttttccncgttgccttacttttaagaggtgtccagtgtcaagggtncagcgtgggtggngtcggtggggggagcgtggccaggccgtggggacgtccctgaacgtcctctctgcgcncgtcctgtcgacttccaccttcagttacctatcgtactagtcgccgtacgtccgggtaacccnccgtaggcctacggaggcgggagggtcgtagggcggtggggtcgacttaattatacgcaatagtgaagtagaaactaagcgacgtctagcccgactacgtcggtagggacggtcctattacccgaactcttacccacggaagtaccctaaacctaacggttaacccgaaagtacccgtaacggtacctaaggttaccttaccggaagtaaacctaacgttacgaaaccgtacgaccggtagacggtacggtacgtaggaaaccggcgtaacgggttcttagggttactttaccgtaggggnggttaaaggggcttaaagggtaagggttccggtaacggttaatagggttttagtcggggtttaaggg

SEQ ID NO: 272348 - DNA, 731 bp, Homo sapiens
  misc_feature: GYAE6OF01AS7RD.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtccagccgtgggacggtccctgacgactctcctgtcgcacgtcctcgtggacttccgaccttcgtaacgtacctatcgacttatcgtccgtaccgtcggggtccccgtaccgacggtcccgtaccggtacggggaccggggtaagggggccggttaggggtacggggttgggggtacggtccggttaatttaacgtaactccgaactagtagtaacgttacggtaaaacttaagtacggacgtactagtccggccgtacgtccggtaggaacgggtccgacttaccgaccctacgtacctacgaagtacgtaactaacttaaccgaaacgaaccgaacgaccgtaattactacgtaagaaacctaacgtacgtaaaccgcggtaccgtagaacggtcgtacgtaggaccggacgtaccgggtagttcggttaagttaacggttcggtaaggtagggaacggtagtaaggtcgggtacggtagttaacgtttggttcgggttaagggg

SEQ ID NO: 272349 - DNA, 769 bp, Homo sapiens
  misc_feature: GYAE6OF01AQXOD.14.25.C03.1.454.CMB.1.raw
  modified_base (160)..(160): a, c, t, g, unknown or other
  misc_feature (160)..(160): n is a, c, g, or t
  modified_base (164)..(164): a, c, t, g, unknown or other
  misc_feature (164)..(164): n is a, c, g, or t
  modified_base (175)..(175): a, c, t, g, unknown or other
  misc_feature (175)..(175): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagcttggttttccngttnctcttttaagngtgtccagtgtcaggtgcagcgtggtgggagtcggtgggggacgcggttcggtccaggccgttaggggacggtccctggacgtactccgtcctggtcgcacggtccctaggtgtacttccaacctttcgaacgttacccgtatccgtaccttaagtcgtaccgtacggttccggggacccacccggtaacgggcccttaccggggaacggccgggggtacggggtcgttcgggggaacggttggggggtactacgggtaaacttttaacaacgttccgtaaacgtaagtggaaacgtttaacggaaaacttaagtacggtaccgtacgttacgcccggtaaccggtaccggttacccggtaaggaaccgggtcccgtaacttccgaacccgttacgtccgtaaccgagtaaacgtaaccaacgttaaccaacggtaacctacgacgtactacctcgtaacacgtaagttaacgacgacggtacctggtaagacggtacgtacggacgtacgaccggttaggtcgttagtacgttagggtagtacggggagtaaggcggtacgggttcgtaagttacggttgttaggggttacgg

SEQ ID NO: 272350 - DNA, 1020 bp, Homo sapiens
  misc_feature: GYAE6OF01AL7QZ.14.25.C03.1.454.CMB.1.raw
tcagcgtctagtaccacgaccggtgctcgattttagtagtgtagatttggggtttgggggggagacgagcccagcactggaagtcgccggtgtttccattcggtgatcagcactgaacacagaggactcaccatgggagtttgggctggagtcgttggggttttttccctcggtttgtccgtttacgttttttaaagggaggggttcgttccgtaggttggttaccgaggggttcggccaagggtcgttggggttagggagggtttccgggttagggggggggagggtcgggttcggggtcccgaacgggtcccggttacgggggggtacggttccccctagggaacgtacccttcccgttcccgttggtcgacccgcgttcccgttgtacggttaccttaccctaccgtttaccgtaccgttaacctagtcgtaccgttagtcggtaccgtacgggttccgggtcccccgacggaccggtcccgtaccgggacggggtacgggggtcggggttaccggagggggtttacggggtgggggtaccggtaacgtttaagttacgtttaagaccggtaaagttaggtaacggtaaacggggttaaaccggtaaaagtttaaaacggacggtaacgttaccggtacggtacccggggtaacccccgtttacggggtacccgggtaaaccgggtaccgggggtaacccttaaccgttaaccgttaaccctacgttaacccgtaccgaaggtaaaccgtaacctaaccgtaaacccgaaacgtaacccgacgtaacgttaacgtacgttaacgtaagaaaccgttaaacgacggtaacgaaccgtcgtaaagggacggttccggacgggtaaggacccgggttaaccggtacgtttacgggttagtttaacgggttttaacgtaacgggggttacggggtaaacgggtagggttaaacgggttaaggggttaccggggttaaaggttaggttttaaaggggtttcggtttagggggtttaaggggg

SEQ ID NO: 272351 - DNA, 713 bp, Homo sapiens
  misc_feature: GYAE6OF01C6TSW.14.25.C03.1.454.CMB.1.raw
  modified_base (197)..(197): a, c, t, g, unknown or other
  misc_feature (197)..(197): n is a, c, g, or t
  modified_base (396)..(396): a, c, t, g, unknown or other
  misc_feature (396)..(396): n is a, c, g, or t
  modified_base (483)..(483): a, c, t, g, unknown or other
  misc_feature (483)..(483): n is a, c, g, or t
  modified_base (673)..(673): a, c, t, g, unknown or other
  misc_feature (673)..(673): n is a, c, g, or t
tcagcgtctagtaccacgaccggtgctcgatttagtagtgtagatttgggtttggggggagacgagccagcactggaagtcgccggtgtttccattcggtgatcagcactgaacacagacgactcacagtggagtttggctgacgcttcggttttccctacggttgtcttacttttaaggaggtcgtcctaggtgtntaacgggtgctaggcgtggttgggaggtcgtggggggacgccggtcgtcccgagcccgtggggtcggtcccctaggagtaccttccgtaccgtggttacgacctaggccccttggttacggtaactttccgaacctttaccgaagttacccgttatcgacctacgtcgactacggtccggaccgaccgagccgtaccgngggacggtgggtcctggggtaggtcgggtcggtatacgttagtatccaacgtaaggttgaaaggttacgaacggtttaaggaaccgngtaccttaagccgaacccggtacctccgggtaaggaacggtcgacttaccgactacgttcacacgtaacgactaactaccgaacgacgtacgagtacttacgtacagaaccgtaagacgaacaccggttctacgagaccgtagaggtaccggatcggacgtagtacgttaagtcggtgggtagaacggtnttaagggacccgggtagttagtaggttcgttagttacggg

SEQ ID NO: 272352 - DNA, 728 bp, Homo sapiens
  misc_feature: GYAE6OF01DY0OQ.14.25.C03.1.454.CMB.1.raw
  modified_base (633)..(633): a, c, t, g, unknown or other
  misc_feature (633)..(633): n is a, c, g, or t
  modified_base (694)..(694): a, c, t, g, unknown or other
  misc_feature (694)..(694): n is a, c, g, or t
  modified_base (704)..(704): a, c, t, g, unknown or other
  misc_feature (704)..(704): n is a, c, g, or t
tcagcgtctagtaccacgaccggtgctcgatttagtagtgtagatttgggtttggggagacgagcccagcactggaagtcgccggttgtttccattcggtgatcagcactgaaccacagaggactcaccatggagtttgggctgagccgttgggtttttcctcgttgcttacgttttaagaggtgtccaggtgtcaggtgcgagtcgttgggtcggaggtcggtggggggacggtcggtcggtccaggtcccgtgggggacgttcccgtggacgtaccttccgtcctggtacgccgtacggtcccctgttaggtaactttccctacccgtttcgaacgttacccttagtcgtaccttaaggtcgtacgtaccggttccggtacccacggtaccggtcttacccggggagggacggggtacggggcgtttacgggggaggttaggggggtcctaggttaaactttacgtactaccaagttacttagggaattaacgggtaaaccttaagacggtaactagtacgtcgggccctaccggtacggtacgggacggtacgtactcgtaacctctacgtaccgaagtaacgaactaacgttaaccaacgaaccgacgacgtaagtactacgtaacganaactaagactacgcgtagagagtcgagacggtacgacgtcggtaagtagttacgtgtgggnggagtacggngtacgtggtacgtatggtcgtagg

SEQ ID NO: 272353 - DNA, 772 bp, Homo sapiens
  misc_feature: GYAE6OF01ALXWB.14.25.C03.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (725)..(725): a, c, t, g, unknown or other
  misc_feature (725)..(725): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttggctgagctgggttttcctcgttgcttcttttaagaggtntccagtgtcaggtncagctggtggagtcgtgggggagtcggtggtccaggtccgtggggacggtccctggacgtaccttcgtccgtagtcgcctacggtcccttacgttgggacttttcccgacctttacggactttaacccgtattcggacctttattcggaccttaacgggtcggggttccccgtaacgaacggttccctcggaacggggtcgggtaagggggtccgtaggggtacggttgggggtcgggaaccttatttaaagtcgtaacccgataaggttcgaacgtttaaccgggaaactttaaaagcggtaacccgttcgttaacgtccggtaccgttaacccggttacgggaacggtaaccggggtcctaacttacccgaacctacgtacctaccgaaagtaacgtaacctaacctaaccgaaacgtaccacgacgtaagtacttacgaacgaactaaacgtacggaaactacgtaccgggtaagaacgtacggacgtacggaacggtccggagtccgtaggttacgttagttaccggngggtacgtaggtacgtagtaggtacgtagtagttagttggttaaggg

SEQ ID NO: 272354 - DNA, 949 bp, Homo sapiens
  misc_feature: GYAE6OF01D5GKU.14.25.C03.1.454.CMB.1.raw
  modified_base (196)..(196): a, c, t, g, unknown or other
  misc_feature (196)..(196): n is a, c, g, or t
tcagcgtctagtaccacgaccggtgctcgattttagtagtgtagatttggggtttggggggggagacgagcccagcactggaagtcgccggtgtttccattcggtgatcagcactgaacacagaggactcaccagtggtagtttgggcttggagtcgtttgggtttttcctcgtttgtcctttagtttttaaaggngggttcgtccaggttgtcgaggtcgcaggtcgtgggtggtaggtcgggtgggggacgtcggtcggtccaggtccggttaggggaccgttcccgtaggacgtaccttccgtccgtggtcgaccgtcgtccttcgtagtaccttccctacctttacgaaccgtttacctagttacgtaccgttagttaccggacccgttaccgggttccgggggttaccccgacccggtaccggggtccccttaccgggggggaaccggggtaccggggggtaaggggggttcctggggggggttaacgggttcggggggttaacggttaaaccgtttaatttaaacggttacctacccgtaaggttaggtaagggtaaacgggtttaaaacgtaaaaaccgtttaacggaccgggtaacgtaaccgtttaacgtcccgggtaaccccgtaacggttaccgggaacggggtaaccgggtaccgttaaccttacccgaaccctacgttaccgtaacgaagtaaaccgtaaccttaaacgtaaacccgaaactaacccgacgtacgtaacgttcgtaacctaagtaaacgtaacgtacgaaaccgtccggtagtaacggaacggtacgtacggaccggggtaacgtacggtaccggtttagtacggtttacggtttaacgttcgggggaagggttaacgggaagggttaagggttacgggttaagggttacccggtaagtttaggttacgggtttgggttaaggggg

SEQ ID NO: 272355 - DNA, 820 bp, Homo sapiens
  misc_feature: GYAE6OF01CVPJS.14.25.C03.1.454.CMB.1.raw
  modified_base (394)..(394): a, c, t, g, unknown or other
  misc_feature (394)..(394): n is a, c, g, or t
  modified_base (683)..(683): a, c, t, g, unknown or other
  misc_feature (683)..(683): n is a, c, g, or t
tcagcgtctagtaccacgaccggtgctcgatttagtagtgtagatttggggtttggggggagacgagcccagcactggaagtcgccggtgtttccattcggtgatcagcactgaacacagaggactcaccatggtagttgggactggagtcgttgggttttcctcgttgctttacgttttaaggagggttgtacccgtaaggttcgtacgtaaggggttcgaccggtaggtcggttggggtacgggtagggttccggggtagggggggaacggtcgggttcgggtaccgaacggtccggtaggggtaccggtccgttagaacgtcctaccgtcgtaggtcacgaccgtcgtacgtggttaccttcctaccgtttacgaacgttaacctggttanaccgttgtcgccggtcggcggttaccccgacggtaggccccgttacgggagggtacggggtacggggtcggtaagggggggttaagggtcggtaacttaatttaaggaccctataacggttagtaacggtaagtaacggaaactaaggtaccaccgggtactccgtaacgggtacccccttacgggagggaacggtaaccgggtaccgtaacttcgtaacctaccgtaaccgaacgtaacgaacgtaacctaaactaaccgaacaacggtactacgtagtactacgaanaacgtaataacgaacgtagacggtacgaacggtaggacggtacggacgtaacgtaggtaccgtgttacggttacggtaggtaggacgggtaagacggtacgggtaggtacggttaggtagttaggtcggttaagggg

SEQ ID NO: 272356 - DNA, 666 bp, Homo sapiens
  misc_feature: GYAE6OF01AZQC9.14.25.C03.1.454.CMB.1.raw
  modified_base (565)..(565): a, c, t, g, unknown or other
  misc_feature (565)..(565): n is a, c, g, or t
  modified_base (597)..(597): a, c, t, g, unknown or other
  misc_feature (597)..(597): n is a, c, g, or t
  modified_base (618)..(618): a, c, t, g, unknown or other
  misc_feature (618)..(618): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtgggggaggcggtggtccaggccgtggggacggtccctggacgacctcgtccgtggtcgccacgccgtcgtggattcctaccttcgaacgttacctatcggcttagcgccgtacgttccggggtccccgccgacggcctaccggacgggcggaggggcgtgggagggtcggggtcgcggtaattctatcgactagtgacgtaggaaacctaagtaggtaccgcgtttacgccggtacccgtaaccgttccgggaggtaaccgggcccgttaatcccaaccgtcgtacctaccgaagtacgaacctaaacgtacccaagaacctacggacgtagttacctcgtacaacaagcgaacncggacgtagaacgcgactagggacgtaacggnggtcttgttagtacttacggngggtggagtagtgggtacggtacggtaggtaacttggtggttacgggg

SEQ ID NO: 272357 - DNA, 733 bp, Homo sapiens
  misc_feature: GYAE6OF01CC4SC.14.25.C03.1.454.CMB.1.raw
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (313)..(313): a, c, t, g, unknown or other
  misc_feature (313)..(313): n is a, c, g, or t
  modified_base (414)..(414): a, c, t, g, unknown or other
  misc_feature (414)..(414): n is a, c, g, or t
  modified_base (465)..(465): a, c, t, g, unknown or other
  misc_feature (465)..(465): n is a, c, g, or t
tcagcgtctagtaccacgaccggtgctcgatttagtagtgtagatttggggtttgggggggagacgagcccagcactggaagtcgccggtgtttccattcggtgatcagcactgaacacagagactcaccatggatttgggctgagctgggttttccncgttgctcttttaagnggtntccagtgtcaggtgcagctgggtggagtcgtggggggagcgtggtccagcctggggaggtccctgagactctcctggtgccaggccttcgtggtaacttcctaccgttacaacggttaccctagtcgccttaagnggacctacgtcggggtccgaccgacgggtacctccgaaggggtcccggaacggggggtcttaggggcggttgggggtcgacgtaagtttatatccgaagtntggaagtaggaaacttagtacgacggtcaagtcggacccgtacgttacggnggaaccggtccggtattacccgaactctacctaccggaacgtcgtaaacctaacgtaaccgaaacgtaaccaccggtacgtaagtactacggtacaaacgaaattacggaaaccacggtaccgtaacggaacggtaggccggtaggaacgggtacctaacggggtccttagggttaacgtttacggttacggtaggggtcggggaaagtacgggtaaggtaccggggttagggttaaccgtaaggttttacggtgggtttaaacgggg

SEQ ID NO: 272358 - DNA, 721 bp, Homo sapiens
  misc_feature: GYAE6OF01A8YWD.14.25.C03.1.454.CMB.1.raw
  modified_base (253)..(253): a, c, t, g, unknown or other
  misc_feature (253)..(253): n is a, c, g, or t
  modified_base (664)..(664): a, c, t, g, unknown or other
  misc_feature (664)..(664): n is a, c, g, or t
  modified_base (667)..(669): a, c, t, g, unknown or other
  misc_feature (667)..(669): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (683)..(683): a, c, t, g, unknown or other
  misc_feature (683)..(683): n is a, c, g, or t
  modified_base (687)..(687): a, c, t, g, unknown or other
  misc_feature (687)..(687): n is a, c, g, or t
  modified_base (691)..(691): a, c, t, g, unknown or other
  misc_feature (691)..(691): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (711)..(711): a, c, t, g, unknown or other
  misc_feature (711)..(711): n is a, c, g, or t
  modified_base (715)..(716): a, c, t, g, unknown or other
  misc_feature (715)..(716): n is a, c, g, or t
tcagcgtctagtaccacgaccggtgctcgatttagtagtgtagatttgggtttgggcgattatatcacatgatggaactaatagacgctatcgccgactccgtggaagggccgattcaccatctccagagacaattccaagaacacgcagtatctagactaaatgaaaccagtccgtaggagacgcgtaggacggaccgacggtcgttgttgttacttacggtggtggggaagaggctaggggaggttacgtntttagttggttaggttggggtacggttcggcgtagtactttaaagtaacgtcgggtaacgtcccggacccgggtcgggaccggaacgggtaacccgtcggtcctaccgtccgtccgtacaccgtaccccgtaccgaacccggtaaccggtcccttaccgtcccggtttaccccgtttccccggaccggtccccctaccccgttaccggtacccaaacgggtcaccccgttaccgtaaccgggtccggggacctaacggcccgggcccggtccggtacggggtcccttacggggtacccgtacggtaacggaaacccggttaccttaaccggttcccgtaacgtacggtacgtacgtcgggacgggttcccgggacgcgggaacctacgggtacagacggtagctgatgcgngcnnncgcncncncgtgcngtcncgcngtacncntgtacgacgcgcncganncgtgc

SEQ ID NO: 272359 - DNA, 808 bp, Homo sapiens
  misc_feature: GYAE6OF01DHYPS.14.25.C03.1.454.CMB.1.raw
  modified_base (424)..(424): a, c, t, g, unknown or other
  misc_feature (424)..(424): n is a, c, g, or t
  modified_base (500)..(500): a, c, t, g, unknown or other
  misc_feature (500)..(500): n is a, c, g, or t
tcagcgtctagtaccacgaccggtgctcgatttagtagtgtagatttgggtttgggggggagacgagcccagcactggaagtcgccggtgtttccattcggtgatcagcactgaacacagagactcaccatggtagtttgggctgagtcttgggttttcctcgttgcttacgttttaaggaggtcgtacctagtgtcgaggtgcgagtcgttgggtacgggtaggtccgggttagggggggacggtccggttccgggtacccgaggtcccggttgggggtaaccgggttccccctagggtaaccgaccctttccggtcccgttggtaccgtacgaccggtccccttcggtaggttaacctttccgtaccttaccgtacgttacccttagtcggtacttagtacgaccgtacggtccgggtaccnccggacggccgtacggcggggtgggtaccgggcgtaggggcgggttagggtcgtacgttattacgtctacaacgtntacggaattacggaaattaacgtagaaccgtctaacggtccgtccggtaacgtaccgggtacggtaaccgccgttaaccttccgaaccgtacttccgaccgtaacggacgtaaaccgtaaccgtaaccgaacggaacctaacgacgtactacctagtaacacgtaaacgtaccgacgtaaccgtcggtaagtacgtacgtacgacggaaccgtaacggttcgacggttgttaaggtaacgttcgggttaggacgggtaagttacggagttaccggggtagtaggttaaggttcggttagggttacggg

SEQ ID NO: 272360 - DNA, 820 bp, Homo sapiens
  misc_feature: GYAE6OF01C2HUP.14.25.C03.1.454.CMB.1.raw
  modified_base (242)..(242): a, c, t, g, unknown or other
  misc_feature (242)..(242): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggacctcaccatggtaggtttgggctgaggtcgttgggttttcctcgttgtcctttacgttttaaggaggttcgtccaggttgtcgaggtgcagtcgtgggtggtaggtcgggtagggggnggtcggtcgggcctacggtccgtaggggaccggttccctggaagtcctccgttccgtgtacgccacgcccttagtacggtacttccgtaccttaccagttaccctagtcgacttagccgtaccgtacggtccggggtccaccggtacggcctaccggcggggaccgggtgggggccgttggggaggggttcgggtacgggtaacttaaggttaactaaccgtacctaaggtaggttacgaaagttaaacgggtaaactaaacgtacggtaccgtacgtttacgaccgggtaccctaccgggttaggaccgggtacggtaccgtactacccgaccgtacctacgaccgtaaacgaacgtaactaaccgtaaccgaacgaacctaccgtaacgacgttactacgtataaaccgtaacgtaacgaaccgttacgacccgtaggacgtaacgtcggacggacggtaacggtaccggtacgtttaggtacggtttaaagtcgggttaacgggtaagggtaacggttagggtacgggtaacgggttaacgggtttagttaaacggttggtttcggggtttaggg

SEQ ID NO: 272361 - DNA, 894 bp, Homo sapiens
  misc_feature: GYAE6OF01ATCN5.14.25.C03.1.454.CMB.1.raw
  modified_base (840)..(840): a, c, t, g, unknown or other
  misc_feature (840)..(840): n is a, c, g, or t
tcagcgtctagtaccacgaccggtgctcgatttagtagtgtagatttgggtttgggggggaggacggagcccagcactggaagtcgccggtgtttccattcggtgatcagcactgaacacagaggactcaccatggagtttgggctgagcgtgggttttcctcgttgctacttttaagaggtgtcctagtcgttcgaggtgcagcgtgggtggagttcgtagggggaggtcggtacggtccgagccggttggggaacggttcccctaggacgtaaccgttccgttcccggttaggttcggaccgacgtccttcggtcggtaacttcctaaccgtttactaacggttacccgttaagtttccgaactttgtaccggacgtaccggtttcgggggtaccccgaaccggacggggttcccttacccgggaagggggaccgggtaacggggggtctacgggggttaacggtttcgggggacgttaccggtaaattttacgacgtccgtaacgaacggttgaacggtttaggaaaactttaacgtaggaccgttacttacgggtaccgacccggtaacctttccggggtaacgggaccgggtaccgttacttaccgaaccgttagttcccgacgtaaacgggttaacgaaccttaaaccgttaccgaaaagttacccgaacggttaccctaaagggtaccttcctaaggtaaaccaaacggtacgaaacgccgtaccgttaagaaacggtcgttaacccggagaaccggaaccgttacccggaggtttttaaccgttaccgttaaaccgggttttaaagggccggggttaaagtaccgggttaanaccgggggttacgttaacggtttaagtccggtttaaaggggttgggttaacggg

SEQ ID NO: 272362 - DNA, 814 bp, Homo sapiens
  misc_feature: GYAE6OF01A37G6.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagagactcaccatggagtttgggctgagctgggttttcctcgttgcttcttttaagaggtgtccagtgtcaggtgcagctgggtggagtcgtgggggaggcgtggtccaggccgtggggacgtccctgacgaccttctccgtggtcgcaggcccttcgtaggtactttccaaccctttcaacgttaccctatcgctagtgcctacggtcgggtcccgccgacgggtcctcccggaggggtccggacgggggtcgttacggggagggttgggggttcgggaccggtaaagtttataaccgttccgaactaagttccggtaaagtacgggtaaacttaaaagtaccggtaaccggtacttaagttcccggaacccggtaccgttaccccggggtagggtaaaccgggggtccccgtaacgtttacccaacccgtaccttacccgtacccgtaaacggaacgtaaaccgtaaaccgtttaaccccgaaaacgtaaacccgaacccgtaccgtaaacgttacgttacccgtaacgtaacctaaacgttacgaaacccgtacgtacccgtaggtaacgacggaccggtaggaaccggtaccgaaccgggtcgttaggttacggttaacgttacggtgggttagggaagtaggttaacgggtacgggtaacggttacgaacggtttggttcgggttaagggg

SEQ ID NO: 272363 - DNA, 828 bp, Homo sapiens
  misc_feature: GYAE6OF01DD3HZ.14.25.C03.1.454.CMB.1.raw
  modified_base (218)..(218): a, c, t, g, unknown or other
  misc_feature (218)..(218): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
  modified_base (811)..(811): a, c, t, g, unknown or other
  misc_feature (811)..(811): n is a, c, g, or t
tcagcgtctagtaccacgaccggtgctcgatttagtagtgtagatttgggtttgggggggagacgagcccagcacgtcggaagtcgccggtgtttccattcggtgatcagccactgaacacaggacgaactcaccatggagtttgggctagagtcgtcgggtttttcctcgttgtcctttgttttaaaggaggttcgtcccgtagtcgtacgagggtnaccgagtcgttgggttcggaggtcggtagggggggcggtcggttcgggaccccaggtccggtcggggtaccgttcccgaggaccgtcttcccgtccgttggcgaccgcgtcccgttgtacgtaccttccctaccttttacacgtttaccctagtcgtacttacncgtacgccggttccgggacccnccggaaccgtcccgtaccggggaacgggtccggggaggggtcggttaaggggtggggttgggtacgggacttatttaacgactacctaagtagtagtaagttaaaccggaaacttaacgttaggaacctcgtttaacggcccttaacccggggaacgtccggtaacggacccgggtacctaccttacccaccgtacttccccgaagaccgtaactaaccttaaccgaaccgaacgtaacgtaccgtagtacgttacttaccgaataacccgaaagcgaaccgtacgtaccgtagacggacgttacggaacggacgtaaccgggttcgtacgttacgttacggttaacgttgggtaaccgggtaaagtacgggtaacgttcggggtaaggttaagtacggttttaagnggtttcggggttagggg

SEQ ID NO: 272364 - DNA, 662 bp, Homo sapiens
  misc_feature: GYAE6OF01B04DB.14.25.C03.1.454.CMB.1.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggacggtccctgagactctcctgtgcagcctcgtggacttcgaccctttcgacgttaccctagtgacctagttcgacacgtcggggtcccgccgaggcctccgagggccggaggggctgggaggtgggcgctattanatcangtgatggaaactagacgacntancgaccgacgtccgaggacggcattccaccatccgaccagacgaactagtaccaagaccacgactagtactcgtaagactaaagtcgaaccgtacgacccgttaggacggaccgtacgtacggggtaacggaaccggtacgggtaccgttagggtttaacgtttaacggtttaccggggtttagggtaacggggggaagttaggggtaagttacggggggtacggttaacggttaggtttaacgggtttgggtttaaacgggggg

SEQ ID NO: 272365 - DNA, 965 bp, Homo sapiens
  misc_feature: GYAE6OF01BTF6P.14.25.C03.1.454.CMB.1.raw
tcagcgtctagtaccacgaccggtgctcgatttagtagtgtagatttggggtttgggggggagacgagcccagcactggaagtcgccggtgtttccattcggtgatcagcactgaacacagagacctcaccatggagtttgggctgagtcgttgggtttttcctcgttgtcttacgtttttaaggaggtgtccagttgtcgtaggtgcagtcgtggtggagtcggtggggaggtcgtcggtccgagccgtggggacggtccccgtggacgtaccttcctccgtgtcgccgacgtcccgtagtacggtactttaccctaccgtttactacgttaccttagtcgtacctagtaccgacggtacggttccggggtacccgcccggtaacggtccccgtaccgggaacggggtccggggtacggggtccggtagggggttacggggttcggggggttacggtaccggtttaaagttttaaccgtaacgttaccctaaaggtagttaacgggtaacgtttaaacgggtaaaacttaacggtaaccgggtaaaccttccggtaacggtaccccgggtaccccggttaaaccggtttcccggggaaacgggtaaaccggggttacccggtttaacctttacccaaaccccgtttaaccttaccggttaaacccgaaagggtaaacccggtaaacccttaaaaccgttaaacccgaaaaccggtaaacccgtaaccggtaaccttaacgtttaacgtttaccccgaaagggttaaaccctaaaggtaacccggaaacgtaacccggttaccgtaaacggggtaacgtaacgggtaacccggtagggaaacccggtaccgggttaccggttaccgttagggttaaacggtttacttaacgggtaggggtaagggtaacggtagggttaagggtagggtaaccggttagttaagtttagggtggggtttaacggg

SEQ ID NO: 272366 - DNA, 835 bp, Homo sapiens
  misc_feature: GYAE6OF01AWM1X.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtcgcagctggtggagtcgtgggggagcgtggtccagccgtgggacgtcctgacgactctccgtgtcgcgacgcctgtggtactttccaccctttcgaagttacctagttgtaccttaagttcggctaaccggttcgggggtccccaccgtaacggggtcccttaccggaacggggtccgggaagggggggtccttacggggggtaacgggttggggggtcggaccgttaaattttacgttaagttccaaccgtagtagtaacggtaaggtaaacctaaagttacggaaccgtacttagtacccgggccccgtaaacgtttcccgggtaaggtaacggggtcccgtacgttaccgaccctacgtaccgtaccgtaaggtaacgaactaaaccttacccgaaacgtaaccgaaccgactaacggttactacgtacgaactaaacgtaacgaaccgaccgttccgtaacggtacggtaacgtaccggtaggtaaaccggaaccgtaacccgggtacggttacggttaacggtttaaccgtttaacgggttacggggtacggggttaaaccggtaaggttaaacgggttacggggttaaacgggttaaccgggtttaaagtttacgggtttaacgggtttaacggggg

SEQ ID NO: 272367 - DNA, 706 bp, Homo sapiens
  misc_feature: GYAE6OF01CKL92.14.25.C03.1.454.CMB.1.raw
  modified_base (168)..(168): a, c, t, g, unknown or other
  misc_feature (168)..(168): n is a, c, g, or t
  modified_base (177)..(177): a, c, t, g, unknown or other
  misc_feature (177)..(177): n is a, c, g, or t
  modified_base (181)..(182): a, c, t, g, unknown or other
  misc_feature (181)..(182): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (201)..(203): a, c, t, g, unknown or other
  misc_feature (201)..(203): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (561)..(561): a, c, t, g, unknown or other
  misc_feature (561)..(561): n is a, c, g, or t
  modified_base (634)..(634): a, c, t, g, unknown or other
  misc_feature (634)..(634): n is a, c, g, or t
tcagcgtctagtaccacgaccggtgctcgatttagtagtgtagatttggggtttggggggggagacgagcccagcactggaagtcgccggtgtttccattcggtgatcagcactgaacacagaggactcaccatgggagttgggctggagcgtggtttcgcgtagctnttaagagtncatnngncangngtgngngngggnnngangcaggtgtccnganctntgtagtcacncgtcngtagtctcctagttaccnttaaccntacggctagtcacgttcgaccgggttccngtacggccacgggcgggtaggtgggngtacgggnggtttccggggnaaagggtttntacgtaacgtaccattaaccgaggtaagtaacggtaaacgtaggactagtcggtacgcggtaccgtcggttacggacggacggttccgtactaccgaccgtactacgtaaccggtaagtacgtaaccttaaaccgaacgaacggtaaaccgtcgaaccggtttactacgtaacggaacccgtaaacgtaacgtcccgtaagtacccgggttanacggggtacgtcgggtaacgtacggggtaaacgccggttacggtaccgttaggacggttttccgtaacggggngggtaaggggaaggttaccgggtaacggttggggttactaaggggtttaattcggggttagggttaaacggg

SEQ ID NO: 272368 - DNA, 837 bp, Homo sapiens
  misc_feature: GYAE6OF01ADLIW.14.25.C03.1.454.CMB.1.raw
tcagcgtctagtaccacgaccggtgctcgatttagtagtgtagatttgggtttgggctgagctgggttttcctcgttgctcttttaagaggtgtccagtgtcaggtgcagctggtggagtctgggggaggcgtggtccagcctggggaggtccctgagactctcctgtgcagcctctggattccaccttcagtacctatgctatgcacgtgggtccgccaggctccgagggcggaggggctgggaggtggggtcggacgatttatactcaacagtgagtaggaaactaagtacgacgtctagtcgccgtaccgtccgtagggaacggtccgtaattccaacctacttccctacccaaggtaacgaacctaaacttacccgaaaagaaccaaccgacgtaagttaactcgtagtaacaaattacggaaacgacgtacccgtaggaacgggacggtacgtagggaaacggaaccggaccggggttactttgggttacgtttaagtttaaccggttggggtaaggggacgtaagggtacgtaggggtaagggttacgtaagtttagttagggttagggttacgggttagggtacgtcgttcgggtaaccttaagttaacggtcgggtaaccgttcccccgggtaaccccgggtcgggggtaacccgtaccgggggtaccccgttaccggggttaaccccctacccgggtttacccgtaccccgttaccggaccccgggttacccccgtacccccggtaaaccccgggtaaaccccggggttacccccgttaacccgggttcccccgggttttccccccgttcccccccgggtaccccggg

SEQ ID NO: 272369 - DNA, 779 bp, Homo sapiens
  misc_feature: GYAE6OF01BDXRD.14.25.C03.1.454.CMB.1.raw
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggagtccctgacgactctccgtgtgcagcctcgtggtacttcacctttcacgtacctatacgctatcgcgtacgtcgggtccnccgaggtcctccggaggcggacggggctagggnggtaggggtcggacgtatttatactacgactagtagtaagtaagggaaacttaaagacggtaccgtactagtacggacccgtaacgtcccgggtaggaaacggggtccctaacgttccgaacccattcccgtaccgaagtaacgaacttaaacgttacccgaaaacgaaccgaacccgtaacgtaaacgttaaccgtaccgttacgaaacccgtaaaagttaaccgggaaacccgtacggtaccccgttaagggtaaccgggtaacgtaccgttaacggggaaacgggaccccgggttaacgggtttacccggtttagggtttaagttaaccggttttaacggtaggggttaacgggggtaaaggaacggttagggtacgggggttaaacgggtttataaacgggtttttaggttaggggtttaaaggggg

SEQ ID NO: 272370 - DNA, 730 bp, Homo sapiens
  misc_feature: GYAE6OF01EQDFG.14.25.C03.1.454.CMB.1.raw
  modified_base (347)..(347): a, c, t, g, unknown or other
  misc_feature (347)..(347): n is a, c, g, or t
  modified_base (698)..(698): a, c, t, g, unknown or other
  misc_feature (698)..(698): n is a, c, g, or t
  modified_base (706)..(706): a, c, t, g, unknown or other
  misc_feature (706)..(706): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgttgggttttcctcgttgccttcttttaaggaggttcgtccaggtgtcgaggtgcagcgtgggtggagtcggtgggggaggtccgtggtccaggccgtggggacgtccctgacgtcctctccgtgtgcacgtcctgtggtacttcctacctttcgacgttacctagtcgtctaagttcgacctacggtccggggtcccncggtacggcctccgggaggccgggacggggtcgtggggaggttggggacgtacgtattaagtactcgaacgagtaggaagtacggtaaactagtacgaccgtacgttaagtccggaccctacggtaccggtagggaaccgggtccttacgtacccgtaccttacgtacccgtaccgtaaggaaactaaccgtaacgtaaacccgaagtaaaccccgaccgtaacgttaggttacctacggtaccgaaaccgtaaacgtaggaaacccgtacggtaccgggttaaggaaccgtaacggtccggaacggtacgaacgtccgtcgtagttaggttacctgggtaggcggtaagngtacgggnggttacgagttgttaggtgtaggg

SEQ ID NO: 272371 - DNA, 755 bp, Homo sapiens
  misc_feature: GYAE6OF01D970W.14.25.C03.1.454.CMB.1.raw
  modified_base (347)..(347): a, c, t, g, unknown or other
  misc_feature (347)..(347): n is a, c, g, or t
tcagcgtctagtaccacgaccggtgctcgatttagtagtgtagatttgggtttgggggggagacgagcccagcactggaagtcgccggtgtttccattcggtgatcagcactgaacacagagactcaccatggagtttgggctgagcttgggttttcctcgttgcttacttttaagaggttgtccagttgtcaggtgcgagtcgtgggtggtaggtcggtggggggacggcgtggtccaggccggtggggacggtccctggacgtactcctccgtgtcgcacgtcctcgtaggtacttcctacctttcacgttaccctagtcgctagtgcctacggtcggggtcccnccgtaggccctaccggaggggcgggagggggtctaggggacggttggggtcggacgttaatttacatcgaacgtagtgaacgtaaggtaaactaagtagaaccgtctaacgccgtaccggtaccgtaccggaagggtaaccgggtcccgtaacttaacccaccctaacgttccctaccgaacggtaacgaaacctaacgttaacccgaaaacggtaacccgtaaccgacgttaacgtactacgtacgaactaaacgttacgaaacgtcgacgttaagggagtcgtaccggtaggaaccgggaacctacggggttcttacggtttaagttaacgtttagggtacgggtaggggaaagtcggttaaagggtcgggtaacggttacggtttaattagggtttgggtacggg

SEQ ID NO: 272372 - DNA, 824 bp, Homo sapiens
  misc_feature: GYAE6OF01BHA3F.14.25.C03.1.454.CMB.1.raw
  modified_base (531)..(531): a, c, t, g, unknown or other
  misc_feature (531)..(531): n is a, c, g, or t
  modified_base (680)..(680): a, c, t, g, unknown or other
  misc_feature (680)..(680): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctggagtccgttggggtttttcctcggttgtcttacgttttaaggaggtcgtcctaggtgtcgaggtgcagtcgtggtggaggttcggtgggggacggtcgtcggtaccgacggtccggtaggggaccgttcccgtaggacgtccttccgttccggtggtcgaccgtccggtccttacggttacggtaacctttacccgtacccgttagtaccgttaaaccgtgttaccgtctacgttcgacccgtacggtccgggtcccgccggtacgccgtccgggaacgggccggggtaggggtcgtaggggacggggtttacggggcgggtaacttaattacggtaactacgaaacgttaggaggttaaacggttacggaaaacttaggtaaccggtntacggttactcccggggaaccgttacggtaccgggttaaggaccggttcctaacgttacccaccttactaccgacgtaaaggaacctaacgtaacccaacgaaaccggtaaccaacggttacggaatttacgacgtaacgaacgtaaanccggaaacctcggtacccgtaaagggtcgaccgttcggaacggaagaaccccggggtgttacgtataaacgggtttggttagacggggtgaaccgggagttacgggtagggtaaccgtttagtaacggttagttggggtaaggg

SEQ ID NO: 272373 - DNA, 824 bp, Homo sapiens
  misc_feature: GYAE6OF01AETNQ.14.25.C03.1.454.CMB.1.raw
  modified_base (242)..(242): a, c, t, g, unknown or other
  misc_feature (242)..(242): n is a, c, g, or t
  modified_base (325)..(325): a, c, t, g, unknown or other
  misc_feature (325)..(325): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgcttcgttttaagaggtgtccaggtgtcaggtgcagcgtggtggagtcgtggggagcgtgtccagccgtgggacgtcccngagacctctccgtgtcgccacgtcctacgtcggtacttaccacctttacacgttacctatgctagtcgcgtacgtcggtcccncgtagcctcgaggcggacgggcgttgggacggtggggtacggtacgttaagttacgtagtacccgaattaacgtggaacgtttagggaaaattaacgtaacgggtacctattaacggttccggaaccccggtaaccgttaccgggtaggggtaaccgggtcccgggtaacttaacccgacccgtaaccttaccgtacccgtaaacggaacgtaaaccgtaacccgtttaaaccgaaaccggtaaacccggtaaccggtaaccgtaaccggttaacgttacccggtaacgtaaacccgtaaagttaccggaaaacccgtaccggtaccgtaggtaaccggtaacggtaccggtagggtaaccgggtaccggtacgtacccggtttaggttaccgtttaaacgggtttacggttaggggtaagggtaaccgggtaaggtaacgggtaacggggttaaaccggttaggttaaacggtttaggtttaacggggtttacggggg

SEQ ID NO: 272374 - DNA, 172 bp, Homo sapiens
  misc_feature: GYAE6OF02G9W93.14.25.C03.1.454.CMB.1.raw
  modified_base (171)..(172): a, c, t, g, unknown or other
  misc_feature (171)..(172): n is a, c, g, or t
tcagcgtctagtaccacgaccggtgctcgatttagtagtgtagatttgggtttggggaagaggaagactgacggtccccaggagttcaggtgctgggcacagcggccctgggctgcctggtcaaggactacttccgtactagacgctgagcgggctggcaaggcgcatagnn

SEQ ID NO: 272375 - DNA, 172 bp, Homo sapiens
  misc_feature: GYAE6OF02FVC42.14.25.C03.1.454.CMB.1.raw
  modified_base (172)..(172): a, c, t, g, unknown or other
  misc_feature (172)..(172): n is a, c, g, or t
tcagcgtctagtaccacgaccggtgctcgatttagtagtgtagatttgggtttggggaagaggaagactgacggtcccccaggagttcaggtgctgggcacagcggccctgggctgcctggtcaaggactacttccgtactagacgctgagcgggctggcaaggcgcatagn

SEQ ID NO: 272376 - DNA, 183 bp, Homo sapiens
  misc_feature: GYAE6OF02FKDFK.14.25.C03.1.454.CMB.1.raw
  modified_base (173)..(183): a, c, t, g, unknown or other
  misc_feature (173)..(183): n is a, c, g, or t
tcagcgtctagtaccacgaccggtgctcgatttagtagtgtagatttgggtttggggaaggaggaagactgacggtcccccaggagttcaggtgctgggcacagcggccctgggctgcctggtcaaggactacttccgtactagacgctgagcgggctggcaaggcgcatagnnnnnnnnnnn

SEQ ID NO: 272377 - DNA, 519 bp, Homo sapiens
  misc_feature: GYAE6OF02GSC8L.14.25.C03.1.454.CMB.1.raw
  modified_base (299)..(299): a, c, t, g, unknown or other
  misc_feature (299)..(299): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccncaggctccaggcgaggggctgggagtgggtgcgattatatcacatgatggaactaatagacgctatgccgactccgagaagggccattcacatctcagagacaatccaagaacacgacagtatctgacaaatgaaacagcctagaagacgctaggaaggacgacggctaggtgtaattacgtggtagggagagagtgggaggtcgaagttagttggtagg

SEQ ID NO: 272378 - DNA, 173 bp, Homo sapiens
  misc_feature: GYAE6OF02IQILH.14.25.C03.1.454.CMB.1.raw
  modified_base (173)..(173): a, c, t, g, unknown or other
  misc_feature (173)..(173): n is a, c, g, or t
tcagcgtctagtaccacgaccggtgctcgatttagtagtgtagatttgggtttgggggaagaggaagactgacggtcccccaggagttcaggtgctgggcacagcggccctgggctgcctggtcaaggactacttccgtactagacgctgagcgggctggcaaggcgcatagn

SEQ ID NO: 272379 - DNA, 519 bp, Homo sapiens
  misc_feature: GYAE6OF02F1KQE.14.25.C03.1.454.CMB.1.raw
  modified_base (300)..(300): a, c, t, g, unknown or other
  misc_feature (300)..(300): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttggggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccnccaggctccgaggcgaggggctggagtgggtggcgattatatcacatgatggaactaatagacgctatgccgactccgtgaagggccgattcaccatctccagagacaattccaagaacacgcagtatctgacaaatgaacagcctagagagctagaggacacggctggtgttattacgtggtagggagaggagtgggaggtacgattagttggtaggg

SEQ ID NO: 272380 - DNA, 552 bp, Homo sapiens
  misc_feature: GYAE6OF02IVLTW.14.25.C03.1.454.CMB.1.raw
  modified_base (301)..(301): a, c, t, g, unknown or other
  misc_feature (301)..(301): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtgggtccagcctgggaggtccctgagactctcctgtgcagcctctggattcaccttcagtacctatgctatgcactgggtccnccaggcctccgaggcggaggggctgggagtgggtggcgattatatcacatgatggaactaatagacgctatgcccgactccggtagaacgggccgattccaccatcctccagacgactaattccaaagaacacgcagtatctgacaaatgaaacagcctagagagcgtaggaaggaccacggcttggtagttaacgtttacgtgggtagggagaggtagtggggtaaggtcgtaagttagttggttaaggg

SEQ ID NO: 272381 - DNA, 441 bp, Homo sapiens
  misc_feature: GYAE6OF02JVEGQ.14.25.C03.1.454.CMB.1.raw
  modified_base (428)..(441): a, c, t, g, unknown or other
  misc_feature (428)..(441): n is a, c, g, or t
tcagcgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggccccatccggtcttccccctggccaccctcctccaagagcacctctgggggcacagcggccctgggctgcctggtcaaggctacttccgtactagacgctgagcgggctggcaaggcgcatagcnnnnnnnnnnnnnn

SEQ ID NO: 272382 - DNA, 507 bp, Homo sapiens
  misc_feature: GYAE6OF02HGRFQ.14.25.C03.1.454.CMB.1.raw
  modified_base (299)..(299): a, c, t, g, unknown or other
  misc_feature (299)..(299): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccnccaggctccaggcgaggggctgggagtgggtggcgattatatcacatgatggaactaatagacgctatgccgactccgtgaagggccgattcaccatctcagagacaattccaagaacacgcagtatctgacaaatgaacagcctgagagctgaggacacggctgtgtattacgtgtgggagagagtggaggtcgatagttaggtagg

SEQ ID NO: 272383 - DNA, 503 bp, Homo sapiens
  misc_feature: GYAE6OF02I97X1.14.25.C03.1.454.CMB.1.raw
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctgggagtgggtggcgattatatcacatgatggaactaatagacgctatgccgactccgtgaagggccgattcaccatctccagagacaattcccaagaacacgcagtatctgcaaatgaacagcctgagagctgaggacacggctgtgtattactgtggagagagtggaggtgatagttgtagg

SEQ ID NO: 272384 - DNA, 510 bp, Homo sapiens
  misc_feature: GYAE6OF02IZEJW.14.25.C03.1.454.CMB.1.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccnccaggctccgaggcgaggggctgggagtgggtggcgattanatcacatgatggaactaatagacnctatgccgactccggtgaacgggccgatcacatctccagagacaattaccaagaacacgacagtatctgacaaatgaacagcctagagagcgtagagacacggctgtgtattactggtggagagagtggaggtcgattagtgtagg

SEQ ID NO: 272385 - DNA, 534 bp, Homo sapiens
  misc_feature: GYAE6OF02ICA5S.14.25.C03.1.454.CMB.1.raw
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (458)..(458): a, c, t, g, unknown or other
  misc_feature (458)..(458): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcacctttcagtacctatgctatgcactgggtccncccaggcctccgaggcgaggggctgggagtgggtggcgattanatcacatgatggaactaatagacgctatcgccgactccgtagaacgggccgtattcaccatcctaccagacgacaattaccaagaacacgacagtatctagacaaatagaaacngacctagagagcgtagacggacacggctagtagtattacgtggtgggagagtagtgggaggtcgattagttgtagg

SEQ ID NO: 272386 - DNA, 503 bp, Homo sapiens
  misc_feature: GYAE6OF02I8SZN.14.25.C03.1.454.CMB.1.raw
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactggtccgccaaggctccaggcgaggggctggagtgggtggcgattatatcacatgatggaactaatagacgctatgccgactccgtgaagggccgattcaccatctcagagacaattccaagaacacgcagtatctgacaaatgaacagcctagagagctgaggacacggctgtgtattacgtgtaggagagagtggagtgatagttgtagg

SEQ ID NO: 272387 - DNA, 524 bp, Homo sapiens
  misc_feature: GYAE6OF02IQOPV.14.25.C03.1.454.CMB.1.raw
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
tcagcgtctagtaccacgaccggtgctcgatttagtagtgtagatttgggtttgggggagacgagcccagcactggaagtcgccggtgtttccattcggtgatcagcactgaacacagaggactcaccatggagtttgggctgagcgtggtttcgcgtaggctctttaagaggtgtccagtgtcaggtgcagctggtggagtctgggggagcgtggtccagcctgggaggtccctgagactctcctgtgcagcctntggattccaccttnagtacctatgctatgcactggggtccnccaggctccaggcgaggggctgggagtgggtgcgattagatcacatgaatggaactaatagacgctatgccgatccggtgaagggccgattcaccatctccagagacaattccaaagaacacgacagttactctgactaaatgaaacaggccctggaagagctagaggacacggactggtcgtattactggtaggacgagagtagggaccgtggattagttggtagg

SEQ ID NO: 272388 - DNA, 575 bp, Homo sapiens
  misc_feature: GYAE6OF02HEL4Y.14.25.C03.1.454.CMB.1.raw
  modified_base (303)..(303): a, c, t, g, unknown or other
  misc_feature (303)..(303): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattccaccttcagtacctatgctatgcacgtgggtcccnccaggcctccgaggcggaggggctgggagtgggtggcgtattatatcacatggataggaaactaatacgacgctatcgacccgactccggtaggaacgggccgattccaccactcctaccagagaacaacttaccaacgaacacgacagtatctagacaaatacgaacacgacctaggagacgactaggaacgaccgacggtcgtaggttaggttaattacgtagggtagggaggaaggtagtagggaggttacgtagttagttggtaaggg

SEQ ID NO: 272389 - DNA, 544 bp, Homo sapiens
  misc_feature: GYAE6OF02F8OL4.14.25.C03.1.454.CMB.1.raw
  modified_base (300)..(300): a, c, t, g, unknown or other
  misc_feature (300)..(300): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccnccaggcctccgaggcgaggggctgggagtgggtggcgtattatatcacatgatggaaactaatagacgctatcgccgactccggtagaacgggccgattcacctatcctaccagagacaattccaaagaaccacgcagtatctgacaaatagaaacagacctgaacgagctaggaaggaccacggctggtagttaacgttacgtggtagggagtaggagtgggaggtcgaagttagttggtagg

SEQ ID NO: 272390 - DNA, 523 bp, Homo sapiens
  misc_feature: GYAE6OF02H91XV.14.25.C03.1.454.CMB.1.raw
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaacgggccatcaccatctcagagacaattccaaagaaccacgcagtatctgacaaatgaaacagcctgagagtactggaagacacggctggtagtattacgtggtggggaagaggaggtacggaggtacgaagttagttggtagg

SEQ ID NO: 272391 - DNA, 592 bp, Homo sapiens
  misc_feature: GYAE6OF02GHMW8.14.25.C03.1.454.CMB.1.raw
  modified_base (304)..(304): a, c, t, g, unknown or other
  misc_feature (304)..(304): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctcgtggacttcaccttcagtacctatgctatgcacgtgggtcccncaggcctccgaggcggaggggctgggaggtggggtggcgtatttatactcacatgagtaggaaactaagtacggacgtataacgtcgacccgtacgtccggtagggaaacggggtcccgtaattaccaacctactccgtaccgagaacgaactaacttaccgaaagaacacgacaagtactcgtagacaaatacgaaacacgacctagacgagctaggaacggacgacggtctggtagttacttacgtggtagggagagtagtagggaggtagagttagttggtaggg

SEQ ID NO: 272392 - DNA, 530 bp, Homo sapiens
  misc_feature: GYAE6OF02GZDOH.14.25.C03.1.454.CMB.1.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtccnccaggcctccgaggcgaggggctgggagtgggtggcgattanatcacatgatggaactaatagacgctatcgaccgactccggtgaacgggccgattcaccatctccagagacaattaccaagaacacgacagtactctgacaaatgaacagcctagagagctagacggacgacggctgtagtacttactggtagggagagtagtgggaggtacggtatagttgtagg

SEQ ID NO: 272393 - DNA, 514 bp, Homo sapiens
  misc_feature: GYAE6OF02HK6B9.14.25.C03.1.454.CMB.1.raw
  modified_base (341)..(341): a, c, t, g, unknown or other
  misc_feature (341)..(341): n is a, c, g, or t
  modified_base (363)..(363): a, c, t, g, unknown or other
  misc_feature (363)..(363): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtacctatgctatgcactgggtccgcaggctccgaggcgaggggctgggagtgggtgcgtattagatcanatgatggaactatagacgctancgccgactccgtagaacgggccatcacatctcagagacaataccaagaacacgcagttatctagacaaatgaacagacctagagagctagacggacacggctgttgtaattacgtggtgggagagagtagggaggtcgattgttaggtagg

SEQ ID NO: 272394 - DNA, 607 bp, Homo sapiens
  misc_feature: GYAE6OF02JZALM.14.25.C03.1.454.CMB.1.raw
  modified_base (254)..(254): a, c, t, g, unknown or other
  misc_feature (254)..(254): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (450)..(450): a, c, t, g, unknown or other
  misc_feature (450)..(450): n is a, c, g, or t
tcagcgtctagtaccacgaccggtgctcgatttagtagtgtagatttgggtttggggggtaggacggagcccagcactggaagtcgccggtgtttccattcggtgatcagcactgaacacagaggactcaccatggagtttggctgagctgggttttcctcgttgctcttttaagaggtgtccagtgtcaggtgcagctggtggagtctgggggaggcgtggtccagcctggggaggtccctggagactctccngtgcagcctctggattcacttcagtacctatcgctatgctactgggtcccgcaggcctccagggccggagggcctgggacgtggggtgcggattagatcganagtgagtggaactagtagacgtntatcgcctactccggtggaaacgggccgagttccacctatccgtcccgaagtacgactaacttcccgaaanaaccgtaacgctaacgtacgtctaggacctaaatacggaactacgaccttggaacgacgtcctaggaagggtaccccaagggtcctaggttacgtgtttaaccgtgggttagggacgtagtacgggttggacggtttacgagttaagttggtaaggg

SEQ ID NO: 272395 - DNA, 508 bp, Homo sapiens
  misc_feature: GYAE6OF02JGUP6.14.25.C03.1.454.CMB.1.raw
  modified_base (299)..(299): a, c, t, g, unknown or other
  misc_feature (299)..(299): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccnccaggctccaggcgaggggctgggagtgggtggcgattatatcacatgatggaactaatagacgctatgccgactccgtgaagggccgatcaccatctccagagacaattccaagaacacgcagtatctgacaaatgaacagcctgagagctgacggacacggctgtgtattacgtggtgggagagagtgggaggtcgatagttgtagg

SEQ ID NO: 272396 - DNA, 549 bp, Homo sapiens
  misc_feature: GYAE6OF02IPJJL.14.25.C03.1.454.CMB.1.raw
  modified_base (300)..(300): a, c, t, g, unknown or other
  misc_feature (300)..(300): n is a, c, g, or t
  modified_base (339)..(339): a, c, t, g, unknown or other
  misc_feature (339)..(339): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccncaggctccaggcgaggggctgggagtgggtggcgattanatcacatgatggaaactaatagacgctatcgcccgactcccgtagaacgggccgattcaaccatcctccagacgaactaacttccaaagaaccacgacagtatctagacaaatgaaacagacctagaacgagctagaacggacacggctggtagttaattaccgtggtagggagtaggagtagggaggttcggaattacgttgttaaggg

SEQ ID NO: 272397 - DNA, 440 bp, Homo sapiens
  misc_feature: GYAE6OF02I0AP2.14.25.C03.1.454.CMB.1.raw
  modified_base (430)..(440): a, c, t, g, unknown or other
  misc_feature (430)..(440): n is a, c, g, or t
tcagcgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttccccctggcacccctcctccaagacgcacctctcgggggcacagacggccctggggctgcctggtacagggactacttccgtactagacgctgagcggctggcaaggcgcatagnnnnnnnnnnn

SEQ ID NO: 272398 - DNA, 645 bp, Homo sapiens
  misc_feature: GYAE6OF02H2ZRB.14.25.C03.1.454.CMB.1.raw
  modified_base (307)..(307): a, c, t, g, unknown or other
  misc_feature (307)..(307): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtctggggggaggcgtggtccagcctgggaggtccctgagactctcctgtgcagcctctggattccacctttcagtacctatgctatgctacgtggggtccnccaggcctccgaggcggaggggctgggaggtggggtggcgtattatactcacagtgagtaggaaacttaagtagacgctagtcgccgactccggtagaacgggcctattccacctatcctaccaagacgaactaacttaccgaaagtaaccacgacaagttactacgtagaacaaagtcgaaacacgcccgtaggaagtacgcgtaagggaacggaccgaacgggtccgttaggttacggtttaaacgtttaaccggttggggttaacgggggaaggtaaggtaagggttaggggtaaacgggttccggtaaagttttaggtttacgggttaaggggg

SEQ ID NO: 272399 - DNA, 683 bp, Homo sapiens
  misc_feature: GYAE6OF02G0IKK.14.25.C03.1.454.CMB.1.raw
  modified_base (308)..(308): a, c, t, g, unknown or other
  misc_feature (308)..(308): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtggggggagcggtggtccagcctggggacggtccctgagctctcctgtgcagcctctggattccaccttcagtacctatgctatgcacgtcggggtccnccaggcctccgagggccggagggggctgggagtggggtcggcgtatttatatcgaactagttgaagttacgggaaacttaaagtacggacgtcttaagtcgggccctaacgttcccggtagggaaaccggggtcccgtaagtttacccaaccctacgttacccgtaccgaaggtaacgaaactaaacgttacccaaaaggaaccacggtaccaagttactacgtagaacctaaatacggaaaccacgtacccgtaggaacgagtacgtaggaaacggacgaccgggtcttaggttacgttaacgtttacggtggggtaggggtaaggaagtaggttacggggtaacggttacgtaagtttaggttaggttagggg

SEQ ID NO: 272400 - DNA, 590 bp, Homo sapiens
  misc_feature: GYAE6OF02IKLPG.14.25.C03.1.454.CMB.1.raw
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgcttttttaagaggtgtccagtgtcaggtgcagctggtggagtctgggggaggcgtggtccagcctgggaggtccctgagactctcctgtgcagcctctggattcaccttcagtacctatgctatgcacgtggtccgcaggctccaggcgaggggctggagtgggtgcgattatatcactatgatggaaactaagtagacgtctaagttgcccgtaactcccggtaggaaagggtcccgaatttccaacctaacttacctaccgaggaaacgaacgaaacttacccaaaacggaaacaacggaccagtaatccgtagacaaatagaaacaaggtaccctagaagagcgtagacggaacacgggctagtcgtaagttactggtagggaacgtagagttgggaggtacgaagtagtttagtaggttgggg

SEQ ID NO: 272401 - DNA, 755 bp, Homo sapiens
  misc_feature: GYAE6OF02JIGDF.14.25.C03.1.454.CMB.1.raw
  modified_base (301)..(301): a, c, t, g, unknown or other
  misc_feature (301)..(301): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtacctatgctatgcacgtgggtcccnccaggctccagggcgaggggctgggagtggggtgcgattagtatcacagtgaattagggaaacttaaagtacgaccggtcttaagtcggaccccgacttcccgggtggaaaccgggggtcccgaagtttccaaccctaacttcctacccgaaggaacgaaacctaaacgtttacccaaaacggaaacctaaccggaccgtaaacggttaacttaccgttagaaccgtaaaaacgttaacggaaaccgtaacggtaccccgttagggaacggtaacggtaccgttacgggaaaccggggtaaccgtaacccggggtcccgtttaagggttacgggttttaaaccgtttttaaccgggttaggggtttacggggggaaacggttaagggtaagggtttacgggggtaaccggggtttacggtaaacggttttaaggtttttggggtttaaaggggg

SEQ ID NO: 272402 - DNA, 551 bp, Homo sapiens
  misc_feature: GYAE6OF02IQE80.14.25.C03.1.454.CMB.1.raw
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtacctatgctatgcactgggtccnccaggctccgaggcgagggctgggagtgggtgcgtattagtatcacatgatggaactaagtagacgctangcccaactccggtagaacgggtccattccaccatctaccagagaacaattaccaaagaaccacgacagtactctagactaaatgaacagcctagagagctaggacggacgcggactggtacgtaacttacgtggtaggggagtaggtagtagggtaggtacggtaagttacgttaggttaggg

SEQ ID NO: 272403 - DNA, 550 bp, Homo sapiens
  misc_feature: GYAE6OF02HG0Q1.14.25.C03.1.454.CMB.1.raw
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcacgtgggtccncaggcctccgagggcgaggggctgggagtgggngcgattanatcanatgatggaactaagtagacgntatcgccgactccggtagaacgggccgtattcaccatctaccagacgacaacttaccaaagaacacgacagtatctgacaaatgaacagacctagaagagcgtaggaacgacgacggtctggtagttacttacgtggtagggtaagaggtagtacgggaggttacgtaagttagttggtagg

SEQ ID NO: 272404 - DNA, 584 bp, Homo sapiens
  misc_feature: GYAE6OF02IX63I.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctcgtggattcaccttcacgtacctatgctatgcacgtcgggtccgccaggcctccgagggcggaggggctgggagtggggtgcgtattatatcacatgataggaactaagtagacgtctagtcgccgacgtccgtaggaacgggtccgtattccacctatcctaccaagacgaactaacttacccaaagaaccacgactaagtactctacgacaaagtgaaccacgcctagacgacgtcgtaggaacggacgacggtctaggtacggttaacttacgtgggtaggggagaggtagtagggtaggttacgaagtttaggttggtaggg

SEQ ID NO: 272405 - DNA, 562 bp, Homo sapiens
  misc_feature: GYAE6OF02GL01Y.14.25.C03.1.454.CMB.1.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctcgtggattccaccttcagtacctatgctatgcacgtgggtcccncaggcctccgaggcgaggggctgggagtgggtgcgtattanatcactatgataggaactaagtagacgctagtcgccgactcgtaggaacgggcctatcacatctcagagacaataccaaagaacacgacagtatctagacaaatacgaacacgacctaggaagacgtcgtaggaacggacgtacggtacttggttagttaagttacgtgggtacggggaagaggtagtgggaggttacgtaagttagttggttaagg

SEQ ID NO: 272406 - DNA, 520 bp, Homo sapiens
  misc_feature: GYAE6OF02I9QQK.14.25.C03.1.454.CMB.1.raw
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccnccaggcctccgaggcgaggggctgggagtgggtggcgattanatcacatgatggaactaatagacgctatgccgactccgtgaacgggccattcaccatcctccagacgactaattaccaaagaaccacgacagtatctgacaaatgaacagcctagagagctgaggacncggntggtgtattacgtggtaggagtagagtgggagtcgattagtgtagg

SEQ ID NO: 272407 - DNA, 594 bp, Homo sapiens
  misc_feature: GYAE6OF02H39L7.14.25.C03.1.454.CMB.1.raw
  modified_base (303)..(303): a, c, t, g, unknown or other
  misc_feature (303)..(303): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtaccctatgctatgcacgtgggtcccncgaggcctccgagggcggaggggctgggaggtgggtggcgtattatatcacatgaatggaaactaataggacgtctagtcgccgactcccggtagggaacgggtccgtagttacccacctatcctaccagaacgactaacttacccaaagaaccacgacagtactctgacaaagtacgaacacgcgtagagacgcaggaacggacgacggtctaggttagtatttacggtggttacggggaaggtaaggtaggtcggggtaagggttacggtaagttaggttaggttaggg

SEQ ID NO: 272408 - DNA, 553 bp, Homo sapiens
  misc_feature: GYAE6OF02GROMQ.14.25.C03.1.454.CMB.1.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgagactctcctgtgcagcctctggattcaccttcagtacctatgctatgcactgggtccncaggctccaggcgaggggctgggagtgggtggcgattanatcacatgatggaactaatagacgctagtcgccgactccggtagaacgggccgattccaccatctaccagacgaacaattaccaaagaaccacgacagtatctagacaaatgaacagcctagagagctaggaacgacgacggtctggtagttaagttacgttgggtacgggaaggtaggtagtagggagggttacgtaagttagttaggttaggg

SEQ ID NO: 272409 - DNA, 521 bp, Homo sapiens
  misc_feature: GYAE6OF02F3ZZ6.14.25.C03.1.454.CMB.1.raw
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcactgggtccncaggctccgaggcgaggggctgggagtgggtggcgattanatcacatgatggaactaatagacgctatgtcgactccggtgaacggccgattcacatctcagagacaataccaagaacacgcagtatctagacaaatagaacagacctagagagctaggacggacacggctgtgttaattacgtggtgggagagagtgggaggtgtagttagttggtagg

SEQ ID NO: 272410 - DNA, 571 bp, Homo sapiens
  misc_feature: GYAE6OF02H4ORY.14.25.C03.1.454.CMB.1.raw
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggattcaccttcagtacctatgctatgcacgtgggtccnccaggcctccgaggcggaggggctgggagtgggtggcgtattanatcacatgatggaactaagtagacgctatcgacccgtacgtccggtaggaacgggcctactaccacctactcctaccaagacgactaactaccaaagaaccacgcacgtactctagacaaatacgaacagaccgtagagagacgtaggaacggacgacggcgttggtagttacgttacgtgggtagggagaggtaggtgggaggttacgtattaggttggttaaggg

SEQ ID NO: 272411 - DNA, 611 bp, Homo sapiens
  misc_feature: GYAE6OF02IH0GD.14.25.C03.1.454.CMB.1.raw
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagccgtgggacgtccctggagactctcctgngcngcctcgtggtattccaccttcagttacctatgctagtgctacgtcgggtccgccgaggctaccgagggcggaggggctgggacggtggggtggcgtaattatatcacagtgagtaggaaactaatacgactagtagtacgccgtactccggtaggaacgggccgtacttcaccgtactcctacgagaacgactaacttaccaaagaaccacgacagtactcgtagacaaagtacgaacacgaccgtaggagacgtcgtaggacggaccgacggtccgtggttagttaacttacgtgggtacgggagtaacggaagtaacgggacgggtacggtaaggttcggtacggttaaggg

SEQ ID NO: 272412 - DNA, 673 bp, Homo sapiens
  misc_feature: GYAE6OF02IRM18.14.25.C03.1.454.CMB.1.raw
tcagcgtctagtaccacgaccggtgctcgatttagtagtgtagatttgggtttggggggaggacggagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagctctcctgtgcagcctctggattcaccttcagtacctatgctatgcacgtgggtcccgccaggcctaccgaggcgaggggctggggagtcggggtggccgtagttagtatccaacagtgaagtgggaaactaaagtacggaacggtctaatggacccgaccttccgggtaggaacggggtcccgaagttccaccgacttccgtaccgagacgaactaacgttaccaaacgtaaaccaccggacctaagttactaccgtagaccaaattacggaaacccaggtaaccccttaggaacggacggacgtacgggaaacggtaccgaccgggtacgttacggtacgggttaactttaccgggtaggttacggggtaaggtaacgggtaagtttgggggaacggttacggtaacggttagtttagggttaacgggg

SEQ ID NO: 272413 - DNA, 665 bp, Homo sapiens
  misc_feature: GYAE6OF02IVCLM.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctgtggattcaccttcagtacctatgctatgcacgtgggtcccgccaggcctccgagggcggacggggctgggaggtggggtcggcgtattatatcgaactagtagataggaaactaaagtagacgactatcgcccgtacgtacccggtggaaacgggccgtaattaccaacctactccgtaccgaaggaacgtaaaccgtaaacttacccgaaaacgtaaaccaacgaaccgtaacgtaacttacctaaacaaaagtacgtaaacaacgtaccgtacggaacggtaacgtcgtaggaacgggaaccgaccgggtacgtaggttacgttaacgtttacggttaggtaggggtacggtaaggtaggttagggtaagggttacggtaagttaggtttaggtaggttgggg

SEQ ID NO: 272414 - DNA, 207 bp, Homo sapiens
  misc_feature: GYAE6OF02I8EZW.14.25.C03.1.454.CMB.1.raw
  modified_base (173)..(207): a, c, t, g, unknown or other
  misc_feature (173)..(207): n is a, c, g, or t
tcagcgtctagtaccacgaccggtgctcgatttagtagtgtagatttgggtttgggggaagaggaagactgacggtcccccaggagttcaggtgctgggcacagcggccctgggctgcctggtcaaggactacttccgtactagacgctgagcgggctggcaaggcgcatagnnnnnnnnnnnnnnnnnnnnnnnnnnnnnnnnnnn

SEQ ID NO: 272415 - DNA, 521 bp, Homo sapiens
  misc_feature: GYAE6OF02FKBNP.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtacctatgctatgcacgtgggtcccgccaggcctccgaggcgaggggctgggagtgggtggcgattatatcacatgatggaaactaatagacgctatcgccgactccggtgaagggccgatcacatctccagagacaattccaagaacacgcagtatctgacaaatgaacagcctagagagctagaggacacggctggtgtagtacgtggtagggagagtagtgggaggtcgattagttgtagg

SEQ ID NO: 272416 - DNA, 623 bp, Homo sapiens
  misc_feature: GYAE6OF02JJDKZ.14.25.C03.1.454.CMB.1.raw
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtacctatgctatgcacgtcgggtccnccaggctccgaggcgagggctgggagtgggngcgtattagtactcactatggaatacggaaactaagtagaacgtcttaagtcgcccgtaacgtccggtagggaaacgggccgtagttcccaaccacgttccacccgtaagacgtaactaaattacccgaaaggtaaaccacgacaagttactctagactaaagtacgaaacacgtaccgtagaacgtacgacgtaggaacggacgacggtcgtaggttacgttaacgttacgtgggtacgggaaggtaagtacggtagggacggttacggtaagttagttacggttaggg

SEQ ID NO: 272417 - DNA, 631 bp, Homo sapiens
  misc_feature: GYAE6OF02JCRM7.14.25.C03.1.454.CMB.1.raw
  modified_base (194)..(194): a, c, t, g, unknown or other
  misc_feature (194)..(194): n is a, c, g, or t
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctggggttttcctcgttgctcttttaagaggtgtccagtgtcaggtncagctggtggagtctgggggagcgtggtccagcctgggaggtccctgagactctcctgtgcagcctctggattcaccttcagtacctatgctatgcacgtgggtcccgccaggcctccgagggcggaggggctgggagtgggtgcgtattatatcacatgatggaaactatgacgctatgccgactccggngaagggccgattcacctntcctcgaagacgaactaacttacccaaagtaaccacgacctaagttactaccgttacggaacctaaaacgttacggaaaccgtacggtacccgttagggaaacgtaacgggtaccttaggggaaacggaacccggtaaccggtcgttacgggttagttaacgtttaccgtgggttaacggggagtaacggtagtcgggtaacgggtcgtaacgttagttggttaaggg

SEQ ID NO: 272418 - DNA, 544 bp, Homo sapiens
  misc_feature: GYAE6OF02HJMGA.14.25.C03.1.454.CMB.1.raw
  modified_base (370)..(370): a, c, t, g, unknown or other
  misc_feature (370)..(370): n is a, c, g, or t
  modified_base (402)..(402): a, c, t, g, unknown or other
  misc_feature (402)..(402): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccccgagacctctcctgtgcagcctctggattcaccttcagtacctatgctatgcactgggtcccgcaggctccgaggccgaggggctgggagtggggtggcgattatatcacatgataggaactaatagacnctatcgccgactcgtaggaagggccatcaccntctcagagacaatcaagacacgcagtactctgacaaatcgaacacgacctagagacgctaggacggacgacggctagttagttacgttaacgtggtaggggaagtaggagtgggaggtcgtaagttagtttggtaggtaggg

SEQ ID NO: 272419 - DNA, 731 bp, Homo sapiens
  misc_feature: GYAE6OF02H6694.14.25.C03.1.454.CMB.1.raw
  modified_base (180)..(180): a, c, t, g, unknown or other
  misc_feature (180)..(180): n is a, c, g, or t
  modified_base (309)..(309): a, c, t, g, unknown or other
  misc_feature (309)..(309): n is a, c, g, or t
  modified_base (353)..(353): a, c, t, g, unknown or other
  misc_feature (353)..(353): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctggggttttcctcgttgctcttttaagaggtntccagtgtcaggtgcagctgggtggagtcgtgggggaggcgtggtccagccgtggggagttccctggagactctcctgtgcagcctctggattccaccttcagtacctatgctatgcacgtcgggtccnccaggcctccgagggcggagggctgggagtgggtgcgtaattanatcacagtgataggaaactaataggacgtactacgtcgacccgtacctccggtagggaaaccggggtcccgtaacgttacccgaacccgtaacttacccgtacccggaaacgtaaacggtaaacccttaaaacgtttaacccgtaaaaacggaaaacccgtaaccggtaaccgtaaagttaaccttacgtacggaaacctaaaagttaacgaaaaccgtacggtaacccgtaggaacgggtaacggttccgtaagggaaccggtaaccggaccgggtacgtttaggttacggttaacgtttacggttggggtagggtaacggtaaggtaggttacggggtagggttacggtaaggttttacggtttaggttaacgggg

SEQ ID NO: 272420 - DNA, 635 bp, Homo sapiens
  misc_feature: GYAE6OF02IRY5Z.14.25.C03.1.454.CMB.1.raw
  modified_base (329)..(329): a, c, t, g, unknown or other
  misc_feature (329)..(329): n is a, c, g, or t
  modified_base (423)..(423): a, c, t, g, unknown or other
  misc_feature (423)..(423): n is a, c, g, or t
  modified_base (555)..(555): a, c, t, g, unknown or other
  misc_feature (555)..(555): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagctggtggagtcgtggggggaggcgtggtccaggccgtggggacggtccctggagacctcgtccgtggtgccagccctcgtaggtaattccaccctttcaacgttacctatgctatcgcactcggggtcccnccaaggcctccgagggcggaggggctggggaggttcggggtggcgtaatttagtaactcaacagttggaagttagggaaactaaataggacgtnttagtcgacccgcgtaccggtggaacgggtccgaattccgactaatccctacaagacaactaacttaccaaaacgtacaacgcaagttaactctacgtaaaccaaaattcggaaacctagacctgaagggtnacgtaggaacgacgtacgtctagtcgttaattcgagggttcggaatagacggttgggacgtaggaatttcgttaggtagg

SEQ ID NO: 272421 - DNA, 184 bp, Homo sapiens
  misc_feature: GYAE6OF02GMK30.14.25.C03.1.454.CMB.1.raw
  modified_base (172)..(184): a, c, t, g, unknown or other
  misc_feature (172)..(184): n is a, c, g, or t
tcagcgtctagtaccacgaccggtgctcgatttagtagtgtagatttgggtttgggggaagaggaagactgacggtcccccaggagttcaggtgctgggcacagcggccctgggctgcctggtcaagggactacttccgtacaacgctgagcgggctggcaaggcgcatagnnnnnnnnnnnnn

SEQ ID NO: 272422 - DNA, 674 bp, Homo sapiens
  misc_feature: GYAE6OF02I3VRN.14.25.C03.1.454.CMB.1.raw
  modified_base (375)..(375): a, c, t, g, unknown or other
  misc_feature (375)..(375): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctctttaagaggtgtccagtgtcaggtgcagctggtggagtcgtgggggaggcgtggtccagcctgggaggtccctgagactctcctgtgcagcctctggattcaccttcagtacctatgctatgcacgtgggtcccgccaggctccgaggcggaggggctgggaggtgggtggcgtattatatcacatgagtaggaactaagtacgacgntatcgcccgacgtcccgtagggaacgggtccgtacttacccgaaccctacgttccctccccgaaggtaacgaacctaaactttacccgaaaacgtaaaccgaaccgactaacggttaactccgtagaacctaaaagtacggaaaccctacgtacccgtaggaacgggaacgtccgtaacggaagggaacccgacgggtcgttacggttaacggttaagttttacggttaggggttacgggggaagtaaggtagggttggggtaacgggttaccggtaagtttaggtttaggttaagggg

SEQ ID NO: 272423 - DNA, 655 bp, Homo sapiens
  misc_feature: GYAE6OF02JNHX6.14.25.C03.1.454.CMB.1.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (426)..(426): a, c, t, g, unknown or other
  misc_feature (426)..(426): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggtttcctcgttgctcttttaagaggtgtccagtgtcaggtgcagctggtgagtctggggagcgtggtccagcctgggagtccctgagactctcctgtgcagcctcnggacttcaccttcagtacctatgctatgcacgtgggtccnccaggcctccgaggccggaggggctgggacgtggggtcgacgtatttacgatcgacagttcgatggaaactaagtagacgcttaagtcgacccgactccggtagaacgggtccctattaccaccattccncccgaagacggtaactaacttacccgaaaggaaacctccgaactaagttacgtcctggaaacctaaaagtcggaaactacgtccctaggaacggtacgtaccgtaggaaaccggaccgtaaccgggtcttacgggttaacgttaacgtttaccggttacggggtagggtaacggtaacgggtaggtttacggggaacggtttacgaaggtttaggttagttaacggggg

SEQ ID NO: 272424 - DNA, 613 bp, Homo sapiens
  misc_feature: GYAE6OF02JKSDF.14.25.C03.1.454.CMB.1.raw
  modified_base (329)..(329): a, c, t, g, unknown or other
  misc_feature (329)..(329): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcctctggacttcaccttcagtacctatgctatgcacgtcgggtccgccaggcctccgaggcggaggggctggnggtggggtcggcgatttatatcacatggatggaaacttaagtagacgatacgtcgacccgacgttccgaggaacggggccgtattccgaacctactaccgtaccgaacggacgaacctaaacgttacccaaacgaaccaccgacgtaacgtacgtccgtagaaccgtaaactacgaaacacgaccgtaggaagtacgtacgtaggacgaacgacggtcgttaggttacgtacgttagtgggtaggagaggacgtgggaggtacgtaagttagttaggtaacggg

SEQ ID NO: 272425 - DNA, 632 bp, Homo sapiens
  misc_feature: GYAE6OF02GHDWW.14.25.C03.1.454.CMB.1.raw
  modified_base (308)..(308): a, c, t, g, unknown or other
  misc_feature (308)..(308): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtggggggaggcgtgggtccaggcctgggaggtccctgagactctcctgtgcagcctctggattccacctttcagtacctatgctatgcacgtgggtcccnccgaggctccgaggcggaggggctgggagtggggtggcgtattatatcaactatgaagtggaaactaagtagacgtctatcgacccgtactccggtaggaacgggccgtacttccacctactcctccagacgaactaacttacccgaaagtaaccacgactaagttactctagacaaatacgaaacacgtaccgtagaacgagacgtaggaacggaccgacgggtacgttcggttagttaacgtttaccggtagggttacggggaacggtaagggtaggttacggggtacgggttacgtaaggtttaggttagggtttaagggg

SEQ ID NO: 272426 - DNA, 652 bp, Homo sapiens
  misc_feature: GYAE6OF02F2ZJX.14.25.C03.1.454.CMB.1.raw
  modified_base (305)..(305): a, c, t, g, unknown or other
  misc_feature (305)..(305): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcacgcctctggacttcaccttcagtacctatgctatgcacgtgggtcccnccgagggcctccgagggccggaggggctgggaggtggggtggcgattatatcacatgataggaaactaagtacgacgtctatcgacccgtactccggtaggaacgggccgtacttaccgacctactccgtaccgaaggaacgtaactaaacttacccaaaagaaccaacgacctaagttactcgtacgaactaaagttacggaaacacgtaccgtaggaacgacggtacgtaggaacggacgaaccgggtaccgttaggttaaggttaacgtttacggttagggtacggggaaggtaaggtacggttaggggtaacgggttggtaacgtttaggttaggttaacggg

SEQ ID NO: 272427 - DNA, 630 bp, Homo sapiens
  misc_feature: GYAE6OF02GAKAK.14.25.C03.1.454.CMB.1.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggaggtcggggggaggcgtggtccagcctgggaggttcctgagactctcctgtgcagcctctggattcaccgtcagtagttcnggcatgcactcgggtccnccgaggctccgaggcgaaggggctggattgggggtggtagttatatcgaattatgaagtaggaaactaaataaagacttagngacagtacctccgtaggaaacggggcctattcaacctactcctaccaaggaacgacctacttacccgaacggaaccacgacgttatacgtacgtcgaactaaatcaaacgacgaccgttgaacggtagacgtaggaacggaccgtaacgggacgtaggttacgttaacgttacgtggtacggtaacgtaaaggtacgttaagggtacggtacggccgttacggccggttccgggcccggggtaccg

SEQ ID NO: 272428 - DNA, 671 bp, Homo sapiens
  misc_feature: GYAE6OF02HG8C1.14.25.C03.1.454.CMB.1.raw
  modified_base (304)..(304): a, c, t, g, unknown or other
  misc_feature (304)..(304): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccaggcctggggaggtccctgagactctcctgtgcagcctctggattcaccttcagtacctatgctatgcacgtgggtcccnccagggcctccgagggccggagggggctgggagtggggtggcgtattatatcacgatggatggaaactaagtagacgctaagtcgacccgtactcccggtaggaacggggccgacgttcccaacccaagttccctaccgaaggaacgtaacctaaactttacccgaaaacggtaaaccaaccggactaacggttactactacggaaccaaaagttacgaaaaccgaacggtacccgtaagggaacgacggtccgtaaggaacgggaaccgaccggggtccttagggttaggtttaactttacggttgggtaggggaaggtaggtaggttaggggagggttacggtaagtttaggttaggttaagggg

SEQ ID NO: 272429 - DNA, 562 bp, Homo sapiens
  misc_feature: GYAE6OF02IE2AR.14.25.C03.1.454.CMB.1.raw
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcacgtcgggtccnccaggcctccgagggcggaggggctgggagtgggtggcattanatcanatgatggaactaatagacgtctatcgaccgactcccggtaggaacgggtccgattccaccactctaccagacgacaacttaccaagaaccacgacagtactctgacaaatgaaacagcctagagacgcgtaggaacggaccgacggtctggttacgtagttacgtggtagggagaggtaggtagggtacggtaggtacttaggttggtaggg

SEQ ID NO: 272430 - DNA, 519 bp, Homo sapiens
  misc_feature: GYAE6OF02FRT52.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaacgggccgattcaccatctccagagacaattccaagaaccacgcagtatctagacaaatgaatagcctgacgagccgaggacacggtctgtgtagttactggtgtcagagagtcgggagggggtggtgtagtcgtaagg

SEQ ID NO: 272431 - DNA, 613 bp, Homo sapiens
  misc_feature: GYAE6OF02FS28V.14.25.C03.1.454.CMB.1.raw
  modified_base (511)..(511): a, c, t, g, unknown or other
  misc_feature (511)..(511): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattccaccttcagtacctatgctatgcacgtgggtcccgccaggcctccgagggcggagggggctgggaggtggggtggcgtatttatatcacatgaagtagggaaactaatagacgtctagtcgcccgacttcccggtggaacgggcccgtatccaacctacttcctaccaagacgactaaacttacccgaaagaaccaacgctaacgttactctagacaaagtacgaaacacgacctagagacgngtacggaaggaccgacggcgtaggttacgttaagtttacgtagggtagggaaggtaagtacggtagggtaacgggttacggtaagttagtttaggttaaggg

SEQ ID NO: 272432 - DNA, 671 bp, Homo sapiens
  misc_feature: GYAE6OF02INJKS.14.25.C03.1.454.CMB.1.raw
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattccaccttcagtacctatgctatgcacgtgggtccnccaggctccgagggcggaggggctgggagtgggtggcgtattanatcaacntgataggaactaagtagacgtctatcggacccgtacgtcccggtagggaaacgggtcccgtatttaccaaccctacttccttacccaaggtaacgaacctaaactttacccgaaaacggtaaaccaaccggacctaacggttaacttaccgttacggaactaaaacgttacggaaaccgtaacgtacccgtaaggaagaacgtcgtaggaacgggaccgaaccggtcgttaggttaggttaacgtttaccggtgggttaggggaagtaaggtaggttaggggtaacggttacggtaagtttacggttaggttaagggg

SEQ ID NO: 272433 - DNA, 594 bp, Homo sapiens
  misc_feature: GYAE6OF02FRO0R.14.25.C03.1.454.CMB.1.raw
  modified_base (277)..(277): a, c, t, g, unknown or other
  misc_feature (277)..(277): n is a, c, g, or t
  modified_base (378)..(378): a, c, t, g, unknown or other
  misc_feature (378)..(378): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggttttcctcgttagctctttaagaggtgtccagtgtcaggtgcagctggtggagtcgtgggggaggcgtggtccaggcctgggaggtccctgagactctcctgtgcagcctctggattccaccttnagtacctatgctatgcacgtgggtcccgcgaggcctccgaggccggagggggctgggagtgggtggcgattatatcacatgataggaactaagtagacgtntatcgccgacctccggtaggaacgggccgtatcaccactcctaccagacgacaacttaccaaagaaccgacgactagtactctagactaaatacgaacacgacccgtagacggaacgaccggaacggaacgaccgtcttgtacgttatttcgtggttggtaggtacgaggtacgtttcgttccgggttacgggtcggtacccgggtacggtaccgg

SEQ ID NO: 272434 - DNA, 577 bp, Homo sapiens
  misc_feature: GYAE6OF02H683T.14.25.C03.1.454.CMB.1.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (509)..(509): a, c, t, g, unknown or other
  misc_feature (509)..(509): n is a, c, g, or t
tcagcgtctagtaccacgaccggtgctcgatttagtagtgtagatttgggtttgggggggagacgagcccagcactggaagtcgccggtgtttccattcggtgatcaggcactgaacacagaggactcaccatggagtttgggctgagctgggttttcctcgttgctcttttaagaggtgtccaggtgtcaggtgcagctggtggagtctgggggagcgtggtccagcctgggaggtccctggagactctcctgtgcagcctctggattccaccttnagtacctatgctatgcacgtgggtcccncaggcctcgagggccggaggggctgggagtggggtggcgattagtatcacagtgatggaaactaagtacgacgactagtcgaccgtactccggtaggaacgggccgtattccaaccatcctaccagacgaactaacttaccaaagaacacgacagtactcgtagacaaatagaacagacctagagagctaggaagacgacggtntacggttagtattacggtggtacgggagtaggtagtagggaggtacggtaatttacgttaggttaggg

SEQ ID NO: 272435 - DNA, 631 bp, Homo sapiens
  misc_feature: GYAE6OF02G4TA8.14.25.C03.1.454.CMB.1.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctcgtggattccaccttcagttacctatgctatgcacgtgggtcccncaggcctcgaggcgagggctggagtgggtggcgtatttanacgtcaacatgaagttagggaaacttaagagacgtcttaagtcgaccgacgttccggtaggaaacggggtcccgtactttaccaacctacgtaccctacccgaaggtaacgaaccgtaaacttacccgaaaacggtaaccgaaccggtacaaacggttactacgttacgacaaaacgttacgaaacgtacgtacccgtaggaacgtagacgtaggaacgacgacggtctaggttagtagttacgtggtaggacgtagagtggtaggtagtagttaggttagtacggg

SEQ ID NO: 272436 - DNA, 733 bp, Homo sapiens
  misc_feature: GYAE6OF02I9YAX.14.25.C03.1.454.CMB.1.raw
  modified_base (351)..(351): a, c, t, g, unknown or other
  misc_feature (351)..(351): n is a, c, g, or t
tcagcgtctagtaccacgaccggtgctcgatttagtagtgtagatttgggtttgggggggagacgagaccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggtattcaccttcagttacctatgctatcgcacgtggtccgcaggcctccgaggccggagggctgggaggtgggtggcgtattatctcanatgagtacggtaaactaagtaggacgtctaagtccggacccgtaaccgttccggttaggggaaacgggtcccgtatttaccccaaacccgtattccccgtaccggtaacggaacgtaaaccgtaaacttacccgaaaacggaaacccgtaacggtaccaaaggtttactaccgttacgaaacctaaaacgtacgtaaacgtaccggtaccgtaaggaacggtaacgacggtacgggtaaacggaacccggtacgggtacgttacggtttaacggtttaacgttttaacggttagggggtaacggggtaaacggttaacggtaggggtttaacgggggtaacggttacgggtaaggttttaaggtttaggggttttaacgggg

SEQ ID NO: 272437 - DNA, 689 bp, Homo sapiens
  misc_feature: GYAE6OF02FTISZ.14.25.C03.1.454.CMB.1.raw
  modified_base (262)..(262): a, c, t, g, unknown or other
  misc_feature (262)..(262): n is a, c, g, or t
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgtgcagcctntggattccaccttcacgtacctatgctatgcacgtgggtcccnccgaggcctccgagggccggaggggtctgggagggttgggtggacgtatttanacttcaacgtagttacggaagttacgggaaaaccttaaagttacggaacccggtcgttaacgtccggaccccgtaaccgttacccgggtacggaaaacggggggtccctaacgtttacccgaacccttagttccctaccgaagtaacgaacctaaacttaccgaaaacgaacgtaccgactaagtacttccgtagaactaaagtacgaaccgtacgaccgtagacgtagtacgtacggaacggtaccgacggtcgttggtagtttaaccgttacggttcgggtagggtactaagggtggtacgggtagttacggaatttggtaggttaggg

SEQ ID NO: 272438 - DNA, 703 bp, Homo sapiens
  misc_feature: GYAE6OF02I9TQV.14.25.C03.1.454.CMB.1.raw
  modified_base (178)..(178): a, c, t, g, unknown or other
  misc_feature (178)..(178): n is a, c, g, or t
  modified_base (319)..(319): a, c, t, g, unknown or other
  misc_feature (319)..(319): n is a, c, g, or t
  modified_base (556)..(556): a, c, t, g, unknown or other
  misc_feature (556)..(556): n is a, c, g, or t
tcagcgtctagtaccacgaccggtgctcgatttagtagtgtagatttgggtttggggggagacgagcccagcactggaagtcgccggtgtttccattcggtggatcagcactgaacacagaggactcaccatggagttttgggctgagcgtggtttcgcgtaggctctttaagaggtntccagtgtcaggtgcagtctggtggagtctgggggagtccgtggtccagcctgggacgtcctgagactcgtcctgtcggacagtccctgtggaatttccgaccttcaggttacctagttcgctatgctacgtcggggtccncgaaggcctccgaggtccggaggggccttgggacgtcggggttcgacgtaagttctgtcaacgattgaccgttaggaaacttaagtacggcgtacttacgcggccctaacgtcccggttagggaaccgggtcgtacgttaccaactacttcctaccgaagacgaacgtaaacttaccgaaacgtaaccgaacgaccggtaagtacgttaaccgtcggaataaacgtcggtaaaaccnccgtaccgtaagacgtacgtacgacggaaacggtaccgtacggtacgttacggttacggttaacggttacggtacgggtaacgggtaaggaaggttacgggttacgggttaccgggttaacggtacgtttaggttacgggttacggg

SEQ ID NO: 272439 - DNA, 621 bp, Homo sapiens
  misc_feature: GYAE6OF02F68MB.14.25.C03.1.454.CMB.1.raw
  modified_base (158)..(158): a, c, t, g, unknown or other
  misc_feature (158)..(158): n is a, c, g, or t
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttccncgttgctcttttaagaggtgtccagtgtcaggtgcagctggtggagtctgggggagcgtggtccagcctgggagtccctgagactctcctgtgcagcctcgtggattcaccttnagtacctatgctatgcctacgtgggtcccnccgaggcctccgaggcgaggggctgggacgtgggtgctattagactcacgatgagtggaaactagtacgacgtctaagtcgacccgatccggtggaaacgggcctacttaccgaacctacgtacctacccgaaggtaacgtaacctaaactttacccgaaagaaccgtaaccgacgtaagttactcgtagaccaaaagttcgaaacgcggacccgtggaacgtacgccgtaggaacgtacgaccgtcgttaggtacgttaacgttacgttgggtaaggagtaagtcgtagggtacggtacgtagtacggttgtaacggg

SEQ ID NO: 272440 - DNA, 638 bp, Homo sapiens
  misc_feature: GYAE6OF02IRYVB.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggaggtcgtggggggaggcggtggtccagccgtggggacggtccctgagactcctccgtgtgcagcctctggacttcaccttcagtacctatgctatcgcacgtcgggtccgccaggcctccgagggcggaggggtcgtgggaggtggggtgacggtatttagtataccgacagtgaattagggaaactaagttagacgtctagtcggacccgtacgtcccggtagggaacgggtccgtacttaccacctacgtcctacccgaggaacgaacctaaacgttaccaaacgtaaccaacgactagttactctacgaacaaagtcggaaaccacgtctagggaagtagccgtaggaccggacgtacggcgttagtacgttacgttacggtgggtagggagtagtacggttcgggaggttacgagttaggttggttacggg

SEQ ID NO: 272441 - DNA, 599 bp, Homo sapiens
  misc_feature: GYAE6OF02IATGQ.14.25.C03.1.454.CMB.1.raw
  modified_base (306)..(306): a, c, t, g, unknown or other
  misc_feature (306)..(306): n is a, c, g, or t
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
  modified_base (475)..(475): a, c, t, g, unknown or other
  misc_feature (475)..(475): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggagtccctgagactctcctgtgcagcctctggattccacctttcagtacctatgcttatgcacgtcgggtccncccgaggcctcgaggcgaggggctgggagtgggtggcgtattanatcatatgatggaaactaatagacnctagcgccgtactcggtaggaacgggcctatccacctatacctccaganaactaacttacccaaagaaccacgacaagtactctagacaaagtcgaaacncgacctgagacgcgtaggacgacgtacggcgttaggttagttaacgtttacggtagggtaggggtaacgtaagggtacggttaggggtaacgggttacggtagttttaagggttggttaagggg

SEQ ID NO: 272442 - DNA, 613 bp, Homo sapiens
  misc_feature: GYAE6OF02F0T8Z.14.25.C03.1.454.CMB.1.raw
tcagcgtctagtaccacgaccggtgctcgatttagtagtgtagatttgggtttggggggggagacgagcccagcactggaagtcgccggtgtttccattcggtgatcagcactgaacacagaggactcaccatggagtttgggctgagctgggtttttcctcgttgctcttttaagaggtgtccagtgtcaggttgcagctgggtggagtctgggggagcgtggtccagcctggggagtccctgagactctcctgtgcagcctcgtggattcaccttcacgtacctatcgctatgacacgtgggtcccgccaggcctccgaggcggaggggtctgggagtgggtgcgtattagtatcactgtgagtaggaactaagtagacgtctatcgccctactccggaggaacgggtcctattccacctatcctaccgagacgtaactaaacttaccgaaacgtaaccacgactaagtacttactagaccaaattacgaacgtacgtaccgtagaacgacgagtaggaacggaacgaccggtcttaggtagttaacgttacgtgggtacgggagtaggtacgttaggggtaccggttacgtaagtttagttaggtaaggg

SEQ ID NO: 272443 - DNA, 631 bp, Homo sapiens
  misc_feature: GYAE6OF02H3ZAS.14.25.C03.1.454.CMB.1.raw
  modified_base (321)..(321): a, c, t, g, unknown or other
  misc_feature (321)..(321): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctgttgctcttttaagaggtgtccagtgtcaggtgcagctggtggagtctggggggagcgtggtccagccgtgggagtccctgagactctcctgtgcagcctcgtggattccacctttcgaacgttacccttaagtcgcttaatcggactacgtcggggtcccnccgtaggccctcgaagggcgggaggggcctggggaggttgggtggacggtattaatactcaacgatgaagtaggaaacttactagacgtctagtcaccgacgttccgaggaacgggctagttcccactatacctacgaagagtaaccaacttaccgaaagtaaccacggactaagttcctacgtgaacaaagtacaaccgtacgccgtaagagacggcgtacggaacgacgtacggaccttaggtagttaacgtttagtacgggtagggacgaaggtaggtgggtacgtacggtagttaggttgtacggg

SEQ ID NO: 272444 - DNA, 611 bp, Homo sapiens
  misc_feature: GYAE6OF02JGX2B.14.25.C03.1.454.CMB.1.raw
  modified_base (260)..(260): a, c, t, g, unknown or other
  misc_feature (260)..(260): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagttgggctgagctgggttttcctcgttgctcttttaagaggtgtccagtgtcaggtgcagctggtggagtctgggggaggcgtggtccagcctgggaggtccctgagactctcctgtgcagcctntggattccaccttcagtacctatgctatgcacgtgggtcccncaggctccgaggccggaggggctgggagtggggtggacgtattanagtcaactagtgatagggaaactagtagaccgtctagtcgacccgtactcccggtagggaacgggtcccgtattccaaccactcctaccgaggacgaacctaacttacccaaagtaaaccgaccgacgtagtactctacgactaaagtacgaaacacgcctagacgagccgtaggacggacacgggtctaggtcgttaacgttacgttcgggtaggggagtaggtacggtaggggtaggtacgtaagttaggttaggttagggg

SEQ ID NO: 272445 - DNA, 693 bp, Homo sapiens
  misc_feature: GYAE6OF02IB41S.14.25.C03.1.454.CMB.1.raw
  modified_base (306)..(306): a, c, t, g, unknown or other
  misc_feature (306)..(306): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctgagactctcctgtgcagcctcgtggacttcaccttcagtacctatgctatgcacgtgggtccnccgaggctaccgagggcgagggtctgggaggtgggtcggcgtaattatatcactagtgagtaggaactaagtacgacgcttagtcgacccgtaccgttccggaggaaacggggcctacgttccgaaccctacttccgtacccgaacggaacgtaaacgtaaactttacccgaaaacgaaacccgtaccggaccgtaaagttaacttaccgtacgaaactaaaacgttacgaaaccgtacgtcccgttaaggaacggtacggaccgtagggaaacgggtaacccgacgggttacgttaggtttacggttaacgtttaccggttagggtacggggaagtacggtaggtacggggtacggtaacggtaagtttacggttgggtttaaggg

SEQ ID NO: 272446 - DNA, 555 bp, Homo sapiens
  misc_feature: GYAE6OF02GYM6G.14.25.C03.1.454.CMB.1.raw
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (447)..(447): a, c, t, g, unknown or other
  misc_feature (447)..(447): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctntggattcaccttcagtacctatgctatgcacgtgggtccnccaggcctcgaggcgaggggctgggagtgggtggcgattanatcacatgatggaactaatgacnctatgccgactccgtagaacgggcgattccactatctcagagacaataccaagaccacgcagtactcgtagacaaatcgaaacngacctaggagtacgcgtaggaacgaccgacggcgttagtacgttaagttaccgtgggtacgggagtaggtacggtacgggtaggtacggtagtttagtaggttaaggg

SEQ ID NO: 272447 - DNA, 867 bp, Homo sapiens
  misc_feature: GYAE6OF02F2H4H.14.25.C03.1.454.CMB.1.raw
tcagcgtctagtaccacgaccggtgctcgatttagtagtgtagatttgggttgggggggagacgagcccagcactggaagtcgccggtgtttccattcggtgatcagcaactgaacacgagagactcacctagtggtagttggctgtacgtcgttcggtttcctcgttgtacttagttaggagtcgtacgtagtcgtacgtaggtcgtcgtaggtcggtagggtaggtacgggtacgggtaggggtacgtccggtcggtaccgtacggtccggtacgggtaccgtcctacgtacctccgtccgtcgtagtccgtacgtaccgtctacgtacttacctaccgtaaccttacgtaccgttactgtaccgtacgtaccggtaccgtaccgggtccgggtaccgtacccgggaaccggtcggggtaccggacggggtcgggggaggttaccgggtagggttaggggtacggtttacgggtaacgttaacgtttataaacgttaccggtaacgtaagttaacgtaacggttaacgtaaacgtaaccgtacggtacgtccgtacgtaccggtaccggtaaccggtcggtaccggaaccgtactacccgtactaaccgtaacctaccgtaaccgtaacgtaaccgtaacgtaaaccgtaacgtaaaccgtaacgtaccgtaacgtacgtactaaccgtagtaaccgaaacgtaacgaccggtaacggtacgtaacggtaacgcggtaacgtaacggacgtaacgggtaccttaggttacggtacgttaagggttaacggtagggtaacgggtagtacgggttaaggttaagggtacgttaaggtttaggtaacggtttaggggtcggtaacggg

SEQ ID NO: 272448 - DNA, 628 bp, Homo sapiens
  misc_feature: GYAE6OF02ICNJL.14.25.C03.1.454.CMB.1.raw
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccagcctgggaggtccctgagactctcctgtgcagcctctggattccacctttcagtacctatgctatgcacgtcgggtccnccaggcctccgagggcggaggggctgggaggttggggtggcgtaattntagtcacatgagttagggaaacttaagacgacgtctagtacgccgtacttccgaggacgggccattccacctactcacccgaagacgacctaacttaccgaaacgtaaccacgacagttaactcctagaaccaaagttccgaaacgtacgccgtaagacgaagtccgtagggaccgaacgacggtcgttacggttacgtaacgtttaacggtgggtaggggaaacgtaggtaacggttgggaacgggttacgaagtttaggttgggttaacggg

SEQ ID NO: 272449 - DNA, 669 bp, Homo sapiens
  misc_feature: GYAE6OF02F1LK7.14.25.C03.1.454.CMB.1.raw
  modified_base (313)..(313): a, c, t, g, unknown or other
  misc_feature (313)..(313): n is a, c, g, or t
  modified_base (466)..(466): a, c, t, g, unknown or other
  misc_feature (466)..(466): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcacgcctctggtattccaccctttcacgtacctatgcctatcgctacgtggggtcccnccgagggcctccgagggccggaggggcgtagggaggtggggtggacgtattagtatcgaactagtggaagttacggaaacttaagtacgaacgtctagtcgcccgtaccgttccggtaggaacgggccgtattcccacctatcctaccgaganaacctaataccgaaacgaaccacgacaagttactctacgaactaaacgtgaaaccgacgtaccgtaaggacgacgtcgtacgggaacgtaaccggaccggtagttacgtttaggttaacgtttacggttaggggtaaggggtacggtaagggtaggtacggggtaagggttaccgtaaggttttaggtttaggggttaagggg

SEQ ID NO: 272450 - DNA, 697 bp, Homo sapiens
  misc_feature: GYAE6OF02GGWTO.14.25.C03.1.454.CMB.1.raw
  modified_base (286)..(286): a, c, t, g, unknown or other
  misc_feature (286)..(286): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtggggaggtccctgacgactctcctgtcgcacgtcctcgtggacttccaaccttnacgttacctatcgctagtcgctaccggtggtcccgccgacgggtcctaccgagggcggaggggctgggaggtggggtgcgtattagtactcactagtacgatacggtaaactaagtacggaccgtacttaagtccgacccgtacgttccgggtaggaaaccgggtcccgtaattacccgaacctactccctacccgaagtacgaactaacttacccgaaacgaaccgacgactaagtactacgtacgtaactaaagtacgaaaccgacgccgtagaacggtacgcgtaacgggaacggaccgtacggtacgttaggttacgttaacgttaacggttgggggtaacggggaacggtaaggacggttacggggtaacgggttacggtaaggtttaggtttacgggttaagggg

SEQ ID NO: 272451 - DNA, 670 bp, Homo sapiens
  misc_feature: GYAE6OF02I5QK7.14.25.C03.1.454.CMB.1.raw
  modified_base (313)..(313): a, c, t, g, unknown or other
  misc_feature (313)..(313): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtctggaggaggcgtggtccagcctgggaggtccctgagactctcctgtgcacgccttcgtggacttccaccttcacgtacctatcgactatcgctacgtgggtcccnccgaggcctccgagggcggaggggctgggaggtgggtggcgtattagactcgactagtgatacggaactaagtacgacgtctagtcggacccgtacgtaccgggtaggaacgggcctacttccaccacgttcctaccgagacgtaacctaacgttacccgaaagaaccacgaccgtaacgtatacccgtagaacctaaagtacggaaacctacggtaccgtggaaaggtacgtacggtaacggaacgggtaccggtaccggcgttaggttacggtttaattaccggttagggggtagggtaaacggttagggtaacgggttcgggaacggggtttacggttaggttaggtttagggg

SEQ ID NO: 272452 - DNA, 600 bp, Homo sapiens
  misc_feature: GYAE6OF02J1U0O.14.25.C03.1.454.CMB.1.raw
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (360)..(360): a, c, t, g, unknown or other
  misc_feature (360)..(360): n is a, c, g, or t
tcagcgtctagtaccacgaccggtgctcgatttagtagtgtagatttgggtttggggggaggacggagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggagtccctgacactctcctgtgcaacgtcnggattcagcttcagtagttanggcatgcactgggtcccgcaggctccaggcaaggggctgggagtgggtggcaggttgtgtaggtatggacgaagtanagaagtatggacgtagccgtgacgggcaattcaccatcgtcagacgacaacgttccaaacacgtatagtagtaatctgaccaaaagtcgaaatagaccgttaggaacgtacgtaccgggaacggtaactaccggggccttaggtagtttaacgttactacggttagtccgaagttaggacgtttacgggggaagggggttcgggtaaggtaccttaccgggtaggttaaggtgttaacgg

SEQ ID NO: 272453 - DNA, 691 bp, Homo sapiens
  misc_feature: GYAE6OF02I1DJR.14.25.C03.1.454.CMB.1.raw
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctgggtggagtcgtgggggagtcgtggtccaggcctggggacgttccctgacgactctcctgtgcagcctcgtggacttcaccttcacgtacctatgctatcgcacgtcgggtccncaggcctccgaggcgagggctggaggtgggagcgtattatacncgacgatgagtaggaactaagcgacgctagtcgaccgtacgtacccggtagaacgggccgtattaccaaccgtaacgttcccgtacgtaacggtaacgaaccgttaaaacttacccgaaaacgaaccgtaacggtaactaacggttacgtaccgtaacgaactaaacgtacgtaaaaccgcgtaccgtaggaacggtaacgtaccggtaaggaaaccggtaaccggtacggtacggttaacgttacgggttaacgttaccggtaggggtaacgggtaggtaacgggtacggttacggggtaaccggttacggtaacgttacggttaggttacgggg

SEQ ID NO: 272454 - DNA, 693 bp, Homo sapiens
  misc_feature: GYAE6OF02HAC6W.14.25.C03.1.454.CMB.1.raw
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacggtcccctagagacctctcctgtcgcagcctcgtggattccaccttcagtacctatgctatgctacgtggggtcccncgacggcctccgaggcggaggggctgggaggtgggnggacgtagttatactcgactagtcgagtaggaaactaagtacggactctagtcggccgtaaccgtccggtagggaaccggggccgtaactttacccgaaccctacgtacccgtaccgaacggtaacgtaaccgtaaacgttacccgaaaaggtaaacccgaccgtaccgttaagttactaccgtaggaacctaaagttacgaaaccgtacgtacctaggacgacgtacgtacggaaacggtccgtaaccgggtcgttaggtacgttaacggttacgttaggggtaagggacggtaaggtacggtacgggtaaggttaccgtaagtttagggtttaaggtacgggg

SEQ ID NO: 272455 - DNA, 619 bp, Homo sapiens
  misc_feature: GYAE6OF02FSETC.14.25.C03.1.454.CMB.1.raw
  modified_base (160)..(160): a, c, t, g, unknown or other
  misc_feature (160)..(160): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (390)..(390): a, c, t, g, unknown or other
  misc_feature (390)..(390): n is a, c, g, or t
  modified_base (540)..(540): a, c, t, g, unknown or other
  misc_feature (540)..(540): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggtttttccncgttgcttcttttaagaggtgtccagtgtcaggtgcagctggtggagtcgtgggggagcgtggtccagccctgggacgtccctgagactctcctgtcgcagcctcgtggtacttcaccctttgacgttacctatgcttaatncacgtggccncgaggcctcaggcgaggggtctagggngtgggnggctaggttgtggttggtatggaacgtaagtaataagaaagttanggaccgacgccgtaggaacgggtccctattccgacctattcctacccgaagacgtaacaaacgttaccaaaaccaactaatagtttactaatcgtacgtaactaaatacgaaatacgcgtaggaagtacggaccgtaaggaccacgggtnttacgtagttactttacgaggtcgtaacgagtacgtaaggtggggaaggggttgtagtacgtccgtaggtagtgttacg

SEQ ID NO: 272456 - DNA, 625 bp, Homo sapiens
  misc_feature: GYAE6OF02GBDN6.14.25.C03.1.454.CMB.1.raw
  modified_base (303)..(303): a, c, t, g, unknown or other
  misc_feature (303)..(303): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtacctatgctatgcacgtgggtcccnccaggcctccgagggccggaggggctgggaggtggggtggcgtattatatcacatgaatggaaactaagtagacgctagtcgaccgtactccggtaggaacgggccgtattccaccatcctaccgagaagaactaacttacccaaagaaccaacgacaagtactacgtacgaactaaaagtcgaaacacgtaccgtagaacggacgtacgtaggaacgggaccgaccgggtcgttaggttacgtttaacgttaccggttagggtacggggaaggtaaggtaggtagggtagggttaacgtaagtttagtttagggttaaggg

SEQ ID NO: 272457 - DNA, 697 bp, Homo sapiens
  misc_feature: GYAE6OF02G8Q72.14.25.C03.1.454.CMB.1.raw
  modified_base (422)..(422): a, c, t, g, unknown or other
  misc_feature (422)..(422): n is a, c, g, or t
tcagcgtctagtaccacgaccggtgctcgatttagtagtgtagatttgggtttgggggggaggacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtggggggagcggtggtccaggccgtggggaggtcccgtggagacctctccgtgtcgcacgccctgtggtacttcacctttcagttacctatgctagtgctacgtgggtcccacaggcctaccagggccggaggggtctgggacggttcggggtgaacgtaattttagaactcgaacgtagtgtaacttgggaaaaccttaagacggtaaccngttaacgtcgaccgtaaccgtccggttagggaaccgggtccgtacgttaccaccgtaactcccgtaccgagtaacgtaacgtaaacttaaccgaaaccggtaacaaccggtaccgaacgttaacgtaccgttacgaacctaaaacgttacgaaacgacgtaccgtacggaagaacgtacgtacggaacggacgacggtcgtacggtcgttaaacgttccggtaggttacggaggaacggtagtagggaggtacggtaagttacgttaggttaggg

SEQ ID NO: 272458 - DNA, 665 bp, Homo sapiens
  misc_feature: GYAE6OF02F5Y3J.14.25.C03.1.454.CMB.1.raw
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
  modified_base (571)..(571): a, c, t, g, unknown or other
  misc_feature (571)..(571): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggtttttcctcgttgctcttttaagaggtgtccagtgtcaggtgcagctggtggagtcgtgggggagcgtggtccagcctgggacgtccctgagacctctcctgtgcacgcctcgtggacttcaccttcagtacctatgctatgctacgtcggggtcccncgaggcctccgagggcggaggggctgggaggtgggtgcgtattanatcactagtgagttaggaactaagtacggacgtcttaagcgacccgtaccgttccggtaggaacgggcccgtaatttacccaaccgtacttcccgtaccaagaacgtaacctaacgttaacccgaaagtaaccacgtactagttactccgtagaactaagtacgaaaccgtacgaccgtaggaacgtcgtaccgtaggaacggacgaaccgggttntaggttacgttaacggtttccggtaggggtacggtaacggtaaggtacgggttacgggtaacggttacgttaggtttaggttaggtttaacggg

SEQ ID NO: 272459 - DNA, 687 bp, Homo sapiens
  misc_feature: GYAE6OF02H4F6W.14.25.C03.1.454.CMB.1.raw
  modified_base (383)..(383): a, c, t, g, unknown or other
  misc_feature (383)..(383): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagctctcctgtgcaggtccttcgtggtacttaccgaccttcgacgttacctatcgtactagtcgactacgttggggcccaccgaggtcctaccggaggcggagggtctgggacggtgggtggcgtaatttagataccgtanacgttggaaactaaggtaaacttaatacgtacgtactagtacgccgtacctccggtaaggaccggggacctattacccgacctaacgttccaccgtaagaaacgtaacctaaacgttacccgaaaagaaccgtaacgacgtaagtacttaccgagtaaacgaaacgtacgaacacgtacctaggaacgtacgtacgtaggaaccggaacgtaccggtcggttagttacgttaacgtttaaccgtggggtaggtaacggaacgtaggtacgggtaaggttacgtagtttagttacggttaagggg

SEQ ID NO: 272460 - DNA, 717 bp, Homo sapiens
  misc_feature: GYAE6OF02IG43T.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagacctctcctgtgcagcctcgtggattcacctttcacgtacctatgctatgccacgtcgggtcccgccgaggtcctccgagggcggagggggcttgggaggtgggtgacgtattagtatcgacatgatacggaataagtaggacgtctacgtcgacccgtacgttcccggtaggaaccggggtccgtactttacccaacctacgttaccctaccgaaggaaacgtaaacctaaacgttaccccgaaaaggaaaccctaccggactaacggttactaccgttaggaaacctaaagtaacggaaaccacggtacccgttaaggaacggaacgtaccggtaggaaccgggtaacgaccggggtcgtttacggtttaggtttaaaccgtttacgggttaggggtacggggtaaggtaacgggtaaggttacgggggtaaacggggttacgtaaagggttttagtttagggttaaggggg

SEQ ID NO: 272461 - DNA, 567 bp, Homo sapiens
  misc_feature: GYAE6OF02IRCRW.14.25.C03.1.454.CMB.1.raw
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (515)..(515): a, c, t, g, unknown or other
  misc_feature (515)..(515): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtcctgagactctcctgtgcagcctctggattcaccttcagtacctatgctatgcacgtgggtccncgaggcctcgagggcgagggctgggagtgggtgcgtattatatcanatgagtaggaactaagagacgctagtcggacctacgtccggtaggaacgggccgtaacttccaaccctactccgtaccaagacgaactaacttacccaaacgaaccgaacgacagttactctacgaacaaatacgaacacgacctaggagacgcgtagacggacgacggtntgtagttattacgtggtagggagagagtggaggtacgtagttgttggtaggg

SEQ ID NO: 272462 - DNA, 630 bp, Homo sapiens
  misc_feature: GYAE6OF02IIZV1.14.25.C03.1.454.CMB.1.raw
  modified_base (304)..(304): a, c, t, g, unknown or other
  misc_feature (304)..(304): n is a, c, g, or t
  modified_base (353)..(353): a, c, t, g, unknown or other
  misc_feature (353)..(353): n is a, c, g, or t
  modified_base (477)..(477): a, c, t, g, unknown or other
  misc_feature (477)..(477): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggtttttcctcgttgcttcttttaagaggtgtccagtgtcaggtgcagctggtggagtcgtgggggaggcgtggtccagcctgggagtccctgagactctcctgtgcagcctctggattccaccttcagtacctatgctatgcacgtgggtccnccaggcctccgaggccggaggggctgggaggtggggtggcgtaatttanactcacatggaatggaaactaagtacgacgcttagtcgccgacgttcccggtagggaaccgggccgatttcccgaacctactcctccgagaaacgaacaacttaacccgaaagaaccaaccganaagttaactcctagaactaaattcggaaacaccgccgtaggaacgagtaccgtaggacggtaaccgacgggtcttgggttacgttactttaacggtgggtacggggtaagtaagacggtgggtaagggttcgtaagttttagttaggttaggg

SEQ ID NO: 272463 - DNA, 604 bp, Homo sapiens
  misc_feature: GYAE6OF02FRLBH.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggacggtccctgagactctcctgtgcagcctcgtggattccacctttcagtacctatgctatgcacgtgggtcccgccaggcctccgagggcggaggggctgggagtggggtggcgattatatcacatgatggaactaatagacgctagtcgcccgactccggtaggaacgggccgtattccgacctatccctcgagacgactaacttacccgaaagaaccacgcagttactcgtagacaaacgtacgaaacgacgccgtaggacgacgtacgtaggaacggaccgacgggtctcggtaggttaactttaccgtagggtagggaacggtacggtagtaggggtacggtacggtagttaggtttaggttagggg

SEQ ID NO: 272464 - DNA, 735 bp, Homo sapiens
  misc_feature: GYAE6OF02GUJ3M.14.25.C03.1.454.CMB.1.raw
  modified_base (160)..(160): a, c, t, g, unknown or other
  misc_feature (160)..(160): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggtttttccncgttgctcttttaagaggtgtccagtgtcaggtgcagcgtggtggagtcgtgggggaggcgtggtccagcctgggacgtccctgagactctcctggncagcctntgattcaccttcagttacctatcgacttagtcgacctacggtcggggtcccaccgaacggtcctacccggaggggccgggaggggggtcttacgggggagggttgggggtacgggacgtaagttttaacgagtaccgtaaacgtagttacggaaggttaacgggaaaacttaaagtacgggaaccgtacgttaacgtccggtacccggaaccttacccgggggtaaggaaaccggggtcccgtaactttacccgaacccgtacttacccgtaacaacgggaacgtaaacctaaacgttaacccgaaacgtaaccgaacgtaccgtaactacgtacgtacgaaccgtaaataccggaaactacggacctaagggacgtacgacgtaggacgacgtacggtctacggttagttaacgttaggtgggtaaggtacgaggtaggtacggtaggtacgtaagttagttaggtacgg

SEQ ID NO: 272465 - DNA, 643 bp, Homo sapiens
  misc_feature: GYAE6OF02IYFKB.14.25.C03.1.454.CMB.1.raw
  modified_base (553)..(553): a, c, t, g, unknown or other
  misc_feature (553)..(553): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggaggcggtggtccagcctggggacggtccctggacgaccttctccttggtgcagcctcgtggattcaccttcacgttacctatgactatcgcacgtcgggtcccgccgacggctccgagggcggaggggcgttgggaggtggggtggacgtattaagtctcactagtgagagggtaactaagtacgaacgctagtcgccgtaactccggtagggaacgggtccgtacgttaccgacctacttccgtaccaaggaacgtaacctaaacttaaccgaaacgaaaccacgacgtacgtactacgtgaactaaagtacgaaactcgacgtacgagacggtacnggacggacgtacggacgttgtagttacgttaggttaggtaggtaacgagttaggtagggtacggtacggttaagttaggttggttaaggg

SEQ ID NO: 272466 - DNA, 694 bp, Homo sapiens
  misc_feature: GYAE6OF02H5OAD.14.25.C03.1.454.CMB.1.raw
  modified_base (278)..(278): a, c, t, g, unknown or other
  misc_feature (278)..(278): n is a, c, g, or t
  modified_base (332)..(332): a, c, t, g, unknown or other
  misc_feature (332)..(332): n is a, c, g, or t
  modified_base (379)..(379): a, c, t, g, unknown or other
  misc_feature (379)..(379): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtggggggaggcgtgggtcccaggccctggggacggtcccctggacgacttcctcctggtcgcagccctntaggtacttccaacctttcacgttacctatgcctagtcgctacgtcgggtcccnccgaggcctccgagggcggaggggctggaggtgggtgcgtattatancacatgaatagaaactaagtgacgtctatcgacccgtcctaccggtagggaacgggtccgtatttacccacctaactcccgtacccgaacggaagaaacctaaacttaccccgaaacgaaaccgacccggaatacggttaactacgtacgaacctaaagtcgtaaacctcgacccgttaggaacggtgtaccgtaggaaccggaacctacggggtacctttcgggtacgttaaacgtttaccggttaggggtagggtaacggtaaggtacggttacggggtaaggttacgtaaggttttaggttagggttacggg

SEQ ID NO: 272467 - DNA, 780 bp, Homo sapiens
  misc_feature: GYAE6OF02JJAL5.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtgggacgtcctagacgtctctccgtgtcgacacgtcctcgtggtacttccaaccgttcacgtacctatcgtactagtcgacgtacggttccgggtacccgaccgtacgggtcctccgggaacggggtccgggtacgggggtccgttaagggggtggggttcggggggtacgggacttaacggttttactacgtaccgtaaacgtagtacggtaagtttaaacgggaaacctttaaaaggcggaaaccgttcttaaacggtccgtacccggtacggtaccgggtaagggacgggtacccgttacttacccggaaaccttcgtaccccgtaaccggtaaggtaaaccgaaccgttaaaccgttaacccgaaacgtaaaccgtaccgtactaaacggttacttccggtaacgaaccgtaaagtaacgaaccgacgttacgtggaaccgtagtaacgacggtaacgaacgtccgtagttcgttaacgtcggtttaggacgggtacggaggtaaggtggacgggttagtacggtagtttacggtaggttagggg

SEQ ID NO: 272468 - DNA, 713 bp, Homo sapiens
  misc_feature: GYAE6OF02JVITE.14.25.C03.1.454.CMB.1.raw
  modified_base (257)..(257): a, c, t, g, unknown or other
  misc_feature (257)..(257): n is a, c, g, or t
  modified_base (343)..(343): a, c, t, g, unknown or other
  misc_feature (343)..(343): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggtcgtggtccagccgtgggacgtccctgacgctctcctgtncacgcctgtggattccaccttcgagttacctatcgctagtcgctacgtcggtcccgccaggcctccgaggtcggagggcgtagggnggtgggtacggtacgtatttagtataccgacagtgacgtaggaacctaagtacgcgtacgtagtcgaccctaacgtcccggaggtacgggccgtaacttaccgaccgtacgtcgtaaccgaggtaactaaccgtaaacgttaacccgaaaacgaaccgtaccgtaacgtaaacgttctacgtacgtaaacctaaagttacggaaacgttaccgtaccgtaaaggtacggaaaccgttacggacgggtaaacgggaccttacccggggtacgttaacgtttcgttaacggtttacgaggggttaagggtacggtaagttacggggttacggtacggtttaacggtaagtttacggtttgggtttaacgggg

SEQ ID NO: 272469 - DNA, 1011 bp, Homo sapiens
  misc_feature: GYAE6OF02GO0JJ.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtggggacggtccctggacgtactctcctaggtcacgacggtccttcgtgggtaactttccgaaccctttcaacggttaacccttagttacggccttaaagtcggtacccgtaccggttcgggggttaccccgcccgtaaggggtccctttacccgggaaacggggtcccggggtaaggggggtccgttagggggtaacgggtttggggggtacggggtaccgttaaagttttaaacggtaccttaccgaaaccgtaggttacgtaaagtttacggggtaaaaacctttaaacgttacgggaaaccgtaccgtttaaagtccgggtaaacccccggttaaaccgtttccccggggtaaaggggtaaaacccggggggtccccttaaaccggtttacccgtaaaccccttaacggttacccctttaaaccggaaaacggtaacgtaaaaacccgttaaacttttaaaccccgggaaaaacggtaaaccgaaccgggtaaccgtttaaacgttacccttacgggttaaaccgtaaacccggtaaaagtttaaacccggaaaacccgtaaccgggtccccgtaaacgggttacggaaaccgggttccggttaaagggaaacccggggttaacgaccccgggggttttcgtaaggggttttaacccgtttaaaaggggtttcccggtttacggggggaaacggggttaaaggaaccgggtttaacggtacgggggtttaaaccgggttagttaaacgggtttttacgggtaggtttaacgggggg

SEQ ID NO: 272470 - DNA, 730 bp, Homo sapiens
  misc_feature: GYAE6OF02FZID7.14.25.C03.1.454.CMB.1.raw
  modified_base (254)..(254): a, c, t, g, unknown or other
  misc_feature (254)..(254): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctctgtgcngcctctggattcaccttcagtacctatgctatgctacgtgggtcccgcaggcctaccgagggcggaggggtctgggaggttggggtcggacgtatttatactcaacagtagaattacgggaaaacttaaagtacggaaccggtacttacgtacgggccccgtaacgttcccggttagggaaacgggtcccgtaactttcccgaaccctacgttcccgtaccgaaagtaccggtaaacctaactttaacccgaaacgtaaaccgtaaccgaccgtaaagttaccgtaccgttaggaaaccaaaacggttacgaaaaccgtacggtaccctaagggtacggaacggtcccgtaacgggaaccggaaccgaccgggttcttaagggttacgtttaacgtttaaccgttggggttacggggagtaagggttacggtaggggttaaccgggtggttaagtttacggtttagggttaacggg

SEQ ID NO: 272471 - DNA, 620 bp, Homo sapiens
  misc_feature: GYAE6OF02FV1G9.14.25.C03.1.454.CMB.1.raw
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (460)..(460): a, c, t, g, unknown or other
  misc_feature (460)..(460): n is a, c, g, or t
tcagcgtctagtaccacgaccggtgctcgatttagtagtgtagatttgggtttgggggagacgaacccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctntggattccaccttcagtacctatcgcttangcacttcgggtcccncaggcctccgagggcggaggggctgggaggtggggtgacgtattatatacactatgaagtaggaaacttaagtagacgcttaagtcggacccgtacttccgggaggaacgggcctattaccacctatcccacagacgactaactaccaagacgacncagttactcgagacaaatgaaacgacgtacctaggaagacgtacgtagggaacggtaccgacggttccgtagtaccgttaagtttacgggtaggttagggggaaggtacggtaggtacggggtacggtacgtaagtttggttaccggtagggttacgggg

SEQ ID NO: 272472 - DNA, 583 bp, Homo sapiens
  misc_feature: GYAE6OF02GS0B0.14.25.C03.1.454.CMB.1.raw
  modified_base (341)..(341): a, c, t, g, unknown or other
  misc_feature (341)..(341): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtctgggggagcgtggtccagcctgggaggtccctgagactctcctgtgcagcctctggattcaccttcagtacctatgctatgcactgggtccgccaggctccagggcgaggggctggaggtgggtggcgattanatcacgatgataggaactaagtagacgctaagtgacccgtacgtcccggtaggaaacggggtcccgtactttaccacctatcctaccagacgaacaaacttacccaaagaaccacgactaagtactacgtgaacaaatacgaaactacgaccctagacgagcgtaggaacgacgacggctagtaggttacttacgtgggtaggaggtagtaggtgggtaggtagtacgttagttaggttagg

SEQ ID NO: 272473 - DNA, 556 bp, Homo sapiens
  misc_feature: GYAE6OF02F4LI7.14.25.C03.1.454.CMB.1.raw
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
  modified_base (447)..(447): a, c, t, g, unknown or other
  misc_feature (447)..(447): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacactctcctgtgcaacgtctggattcagcttcagtagttatggcatgcactgggtccnccaggcctccgaggcgaaggggctgggagtgggtggcgtagttggtgtggtatggaacggaagtaatagaaagtntacgccgacgccgtaggaacgggccgtatccacactctacagagacaataccaacaactatgttgtatcgtnacaaagtagaatacgcgtagacgacgacggagaccgacgctgtagtagttactgtagtcgagaggtagtgggtagggggtggtggtacgtaccggaggttagtagttag

SEQ ID NO: 272474 - DNA, 718 bp, Homo sapiens
  misc_feature: GYAE6OF02JOWZ2.14.25.C03.1.454.CMB.1.raw
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctcgtggactttccgaccttcgaacgttacctatcgctatcgctacgtcgggtccgccgaggcctaccgaagggccggaggggcctgggaggttcggggtggacgtatttagactcaccgagtcgagtacggaaactagtagacgtctaagtcgacccgtacgtaccggtaggaacgggtcccgtaacttcccgaaaccgtacgttacccgtaccgaaaggtaacgtaaacctaaacgtttaacccgaaaacgtaaaccgaaccgtaccgtaaacgtttaacgtccgttaagaaaccgtaaagttaacggaaaccgtaacggacccgttaacggaacggtaacgtacggtaagggaaccggaacgtaaccgggtcgttacggtacgttaacgtttaccggtagggtaacgggaagtaacgggtaagttcggggaagttacggtaatttagggttacgttaagggg

SEQ ID NO: 272475 - DNA, 589 bp, Homo sapiens
  misc_feature: GYAE6OF02GG3IP.14.25.C03.1.454.CMB.1.raw
  modified_base (303)..(303): a, c, t, g, unknown or other
  misc_feature (303)..(303): n is a, c, g, or t
  modified_base (479)..(479): a, c, t, g, unknown or other
  misc_feature (479)..(479): n is a, c, g, or t
tcagcgtctagtaccacgaccggtgctcgatttagtagtgtagatttgggtttggggggggagacgagcccagcactggaagtcgccggtgtttccattcggtgatcagcactgaacacagaggactcaccatggagtttgggctgagctgggttttcctcgttgctcttttaagagtgtccagtgtcaggtgcagctggtggagtctgggggaggcgtggtccagcctggggaggtccctgagactctcctgtgcagcctctggattcaccttcagtacctatgctatgcacgtcgggtccnccgaggcctccgaggcggaggggctgggaggtggggtggcgtatttatactcaacgatgaagttaggaaacctaaatacggacgccttaagtgacccgtaccgtccggtaggaacgggccgtattccacctatcctaccagacgaactaactaccaaacaactatgttagtatctnactaatagaatagacctaggagacgaccgacggaacgacggtcgttggtacgttagtttacgtgttcgtagagaggtaggtggggtaggggtgggtaggtagtcgtaagg

SEQ ID NO: 272476 - DNA, 762 bp, Homo sapiens
  misc_feature: GYAE6OF02JAZB5.14.25.C03.1.454.CMB.1.raw
  modified_base (273)..(273): a, c, t, g, unknown or other
  misc_feature (273)..(273): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcaggctggtggagtcgtagggggaggcgtggtccaggccgtgggacggtccctggagctctccgtgtcgcagccttcgnggtacttccgtaccttcaacgtacctagtcgcttagtccgcgtaccgtcgggtcccgaccgaggccctccggaggccgggaggggcgtggggtaaggtcggggtcgggtacgttaagttattacgtaccgacagttaggaacgttagggtaaacttaaacggacgtacgtacgtagtaccggacccgtaaccgttcccgggtaaggggtaaccggtaccgtaacgtttacccaacccgttacgttacccgtacccgtaggtaaaccgtaaaccgtaaacgttaacccgaaacggtaaacccgaaacccggtacgtaaacgttacgtaccgttacgaaaccgttaaagtaccgaaacgtaccgacccgtaggtaacgtacgttaccgtaaggtaaaccggagttaccgggtacgtcggttaggttagtttaccggtagggtacggtagaacgtaggtacgggtacggtagtagttagttacgggttacgg

SEQ ID NO: 272477 - DNA, 736 bp, Homo sapiens
  misc_feature: GYAE6OF02JOE77.14.25.C03.1.454.CMB.1.raw
  modified_base (290)..(290): a, c, t, g, unknown or other
  misc_feature (290)..(290): n is a, c, g, or t
tcagcgtctagtaccacgaccggtgctcgatttagtagtgtagatttgggtttggggggaggacgagcccagcactggaagtcgccggtgtttccattcggtgatcagcactgaacacagaggactcaccatggagtttgggctgagctgggttttcctcgttgctctttaagaggtgtccagtgtcaggtgcagctggtggagtcgtgggggagcgtggtccagcctggggagtccctgagactcctcctgtcgcacggtcctctggacttcgaccttcacgtaacctntcgtctatgaccgtacgtcggggtcccgccgtagggtccctccgaacgggcgggtaagggggtccttagggggacggttagggggtcgggtacgtaaggttttactaacgttccgaacgtagttcggaacggtttacgggaaaaccttaaagtacggtaaacgcctttaagtaccggtccccggaacttacccgggttaacggggaaacgggttcccccgggtaatttaccccggaaccttaccgttcgtaaccccggaaggtaaccggtaaacctaaacgtttacccgaaaagtaaccaccggatacggtacctcgtagacttaaacgacaaacgcgtccgtaagagtaacgtcgtacggaagaacccgtacgtcgttaacggtagttaccgttaacggtggtacgggaatcggaggtcgggaacttggaaacttggttagaggg

SEQ ID NO: 272478 - DNA, 654 bp, Homo sapiens
  misc_feature: GYAE6OF02GT6QP.14.25.C03.1.454.CMB.1.raw
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcctntggattccaccttnagtacctagtgctatgcacgtggggtcccnccaggcctccgagggcggaggggctgggacggtgggtggcgtattagtatcactagtgagtcggaaactaagtagacgcgtaagtcgaccgacgtccggtagaacggggccgtacgttacacccgtaatcctacccgagaacgtaaacgtaacttaacccgaaacgaacctaacggactaacggtattacctacggaactaaacgttacgaaacgtaccgccgtaagaacggtagaccgttaggaaccggaacaaccgggttcctggttacggttaagttaccggttgggtagggaacgtagggtaaggtgggtaaccggttagtacgttaggttaggttaacgggg

SEQ ID NO: 272479 - DNA, 725 bp, Homo sapiens
  misc_feature: GYAE6OF02G3OH0.14.25.C03.1.454.CMB.1.raw
  modified_base (246)..(246): a, c, t, g, unknown or other
  misc_feature (246)..(246): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagcgtggtgagtcgtggggagcgtggtccaggtccgtgggacggttcccnggacgacctcgtccgtgtcgcacgtcctgtaggtacttcctacccttgacgttaccttatcgctacgtcgtcctacggttcggggtcccgcccgagggtcctccggacgggccggggaggggtccgtgggtaggggtcggggtaggtcgttaattacgtacgtaccgaatagtagtaagttacggtaaattaaagtacgaccgtacgttagtccggacccgttaccggtaccggtagggaacccgggttcctagttaaccccgacgtacctaccgtaccgagtaaaccgtactaaccgttaacccgaacgaaaccgaccgtactaacggttactcgtacgaactaaagtacgaaccgacgaccgtacgaagtacgtcgtaacgacggtaccgacgtcgttacgttagttaacgtttacggtggtaagggtaacgtaggtacggttagggacggttacgtaggttacggtttaggtaggg

SEQ ID NO: 272480 - DNA, 820 bp, Homo sapiens
  misc_feature: GYAE6OF02GNVU6.14.25.C03.1.454.CMB.1.raw
  modified_base (308)..(308): a, c, t, g, unknown or other
  misc_feature (308)..(308): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctcgtggattccgaccttcacgtacctagtgctatgctacgtcgggtcccncgaggtcctccgaggccggaggggctgggaggtggggtggacgtaagttatatcgactagtagagttaggaaacttaaagtacgacgtacttaagtccggcccgtaaccgtccgggtaggaaccggggtcccgtaacgttacccgacccgtacttacccgtacccgaacgtaacgtaaacctaaaccgtttaacccgaaaacgtaaacccgtaaaccgtaccgtaacggttaacgttaccgtacgtaaaccgtaaaacgttaaccggaaaccgtaccggtaccgttaagggaaacggtaaccggtaccggtaacggtaaaccggggtaacccgtacccgggttacggtttacggtttaaaccgggttttaaacggttttaaccgggtttacgggggttaaacgggggtaaccgggtttaacggggtaaccggggtttagggggttaaacccgggggtttaaacgggtttaacggtttttaaacggggttttacgggggttttaaacgggggg

SEQ ID NO: 272481 - DNA, 717 bp, Homo sapiens
  misc_feature: GYAE6OF02GO32E.14.25.C03.1.454.CMB.1.raw
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggacgtccctgagactctcgngtgcagcctctggattccaccgttcaaggttacctagtcgctangctacgtcgggtacccnccgaggcctccgagggccggaggggctgggaggtcgggtacggtcgaatttagatcgaactagtaggaacgttacgggaaaattaacgtaagggacctacttaagtcgggacccctaaccgggttacccggtagggaaaccgggtcccgtaacgttacccgaacctaacttcccgtaaccgaaaggtaacgtaaacctaacgttaacccgaaaagtaaaccgaccgtaagtacggttactacgtaggtaaactaaacgtacgtaaaccgacgtaccgtaggaacgtcggacgtaggtaaccgggaccgtacggtaccgttaggtaacgtttaacgttaccgaggggtaggtaacggaggtacggtaggggtaccgtacggtaagtttaccggtgggttaaggg

SEQ ID NO: 272482 - DNA, 802 bp, Homo sapiens
  misc_feature: GYAE6OF02GLS85.14.25.C03.1.454.CMB.1.raw
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccaggcctggggacgtccctgagactctcctgtgcagcctgtggattcaccttnagtacctatgctagtcgcacgttcggggtcccnccgagggtcctaccgagggccggagggggtctggggacggtggggtcggacgtagttactactcactagtggtaagtagggtaaactaaagtacggacgtcgttaatcggacccgtacgttcccggtagggaaacgggtccgtaacttaccgacctacttcccgtaccgaacggtaacgtaaacgtaaaccgtttacccgaaaacggtaaaccgaaccggtaaccgtaacggttaacttaccgtaacgtaaaccgtaaaacgtaacgtaaaaccgaccggtacccgtaacgggtaacggtaaccgtacgttaacgggaaaccgggtaaccggtaaccgggtaccgggtttacggtttaacgggtttaaaccggtttaaccgggttaggggttaacgggggtaaacgggttaacgggtaaacggggtttacgggggtaaaccgggtttaacgggtaaacggtttttaacggggtttaagggttttaacggggg

SEQ ID NO: 272483 - DNA, 558 bp, Homo sapiens
  misc_feature: GYAE6OF02JHKKN.14.25.C03.1.454.CMB.1.raw
  modified_base (303)..(303): a, c, t, g, unknown or other
  misc_feature (303)..(303): n is a, c, g, or t
  modified_base (415)..(415): a, c, t, g, unknown or other
  misc_feature (415)..(415): n is a, c, g, or t
  modified_base (463)..(463): a, c, t, g, unknown or other
  misc_feature (463)..(463): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatcgctatgcacgtgggtcccncgaggcctccgaggcggaggggctgggaggtgggtgcgtattatatcactagtgagtaggaactaagtagacgctatcgccgactccggaggaacgggcctattcaccatcnccagacgactaatccaaagacacgacagtatctagactaaatcgaacncgacctgaagacgctaggaaggaccgacgggtcgtgtagttaacgttacgtgggtagggtagaggtacgtgggtacgtcggagttagttgtaggg

SEQ ID NO: 272484 - DNA, 713 bp, Homo sapiens
  misc_feature: GYAE6OF02IGLHZ.14.25.C03.1.454.CMB.1.raw
  modified_base (181)..(181): a, c, t, g, unknown or other
  misc_feature (181)..(181): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtntccagtgtcaggtgctagctggtggagtcgtgggggagcgtggtccaggccgtgggagtcccctaggacgacttctccgtgtcgcgagcccgttcgtggtacttccgtaccttacgacgttacctagtcgcttaatgacgtacgtcggggtacccgctaacggcctacccggaagggccgggtagggtcgtggggacgggtgggggtacggccggttaaagtttactacgtaccgaagtgttagacgtagggaaaacttataaggaccggtcttagcgtaccgtacgtccgggtaggaaccggtccgtacgttaccgaacctcgttaccgtaccgagtaaccgtaaacgtaaccgttaaccgaaacggtaaccgaacggtacaaagttactacgttagaacgtaaacgtacgtaacaacgtccgaagtacgacgacgtacggaagaccgtacggacgttacgtacggttaagttaccggtggtaacgggagtacgtaggtacgggtacgttacgtagttagtaggttagggg

SEQ ID NO: 272485 - DNA, 960 bp, Homo sapiens
  misc_feature: GYAE6OF02IF8PC.14.25.C03.1.454.CMB.1.raw
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (278)..(278): a, c, t, g, unknown or other
  misc_feature (278)..(278): n is a, c, g, or t
  modified_base (350)..(350): a, c, t, g, unknown or other
  misc_feature (350)..(350): n is a, c, g, or t
  modified_base (455)..(455): a, c, t, g, unknown or other
  misc_feature (455)..(455): n is a, c, g, or t
tcagcgtctagtaccacgaccggtgctcgatttagtagtgtagatttggggtttggggggggagacgagcccagcactggaagtcgccggtgtttccattcggtgatcagcactgaacacagaggactcaccatggagtttgggctgagcgttgggttttcctcgttgcttctttaagnggtntccagtgtcaggtgcagctgggtgagttcgtggggggagcggtcggtccagtccgtaggggacggttccctggacgtactcgtcctggtcgaccngtccctgtaggtactttccgacctttcgaacgttacctatcggcttaatcggacctacggtccgggtacccncgtacgcctccgggaagggcggtacggggtactggggtacggtcggggtacgacgttaacttagttactacgactagtacgtaggtaaccggtaaattaaccggngaacgtttcgtaacgtccggtaccccggtacggttaacccggaagggggttacccggtaccgttaaaccgtacccgttaaaccccgtaccgtttaacccgtaaccgtaacgggaaaaccgttaaaccgtaaacccgtttaacccgtaaaaaaccgggaaacccgttaaaccccgggttaacggttaaacggtttaaaccgttaaaccgtaaccggttaaaacgttaaacccggtaaaccggttaaacggaacccggttaacccgggttaacggtaaccgggaaaccgggtttaacggtaaaccgggggaaacccggttaaccggggaacccgggtttaccggtttaagggttttaccggggttaaaccgtttaaacggggtttaccggggggttaaaccgggggtaaacggtttagggtaacccgggggttttaagggggtttaaaccgggttaacccggggttttaaaacggtttggggtttttacccggggtttaaagggggg

SEQ ID NO: 272486 - DNA, 634 bp, Homo sapiens
  misc_feature: GYAE6OF02F8WX4.14.25.C03.1.454.CMB.1.raw
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcaggcctctggattcaccttnagtacctatgctatgcactggtccncaggctcaggcgagggctggagtgggngcgattanatcanatgatggaactatcgacgctaatgaccgtactccgtaggaacgggtcccgtattccgaaccctagtcctacccgaagacgtaacaactttacccgaaagtaaaccgacggaccgtaggttaactacgtacgtaacaaagttacgaaaccgacgacccgttaggaacgtaaccgtcgttacggaaacgggaccgtaaccgggcgttaccggttaggttaaccgtttaccggttagggttaggggaacgtaaggtacgtacggggtaaggtaccggtaactttacggttggttaacggg

SEQ ID NO: 272487 - DNA, 663 bp, Homo sapiens
  misc_feature: GYAE6OF02JRPYG.14.25.C03.1.454.CMB.1.raw
  modified_base (272)..(272): a, c, t, g, unknown or other
  misc_feature (272)..(272): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtcctgagactctcctgtgcagcctctggattcaccttnagtacctatcgctatgcacgtcgggtacccgcaggcctccgaggcggacggggctgggacgttggggtgcgtaattatacgtcaacagtgaagttacgggaaaacttaagtaaggaccacgttagtcgacccgtaacgtccggtagggaaacgggccgtattaccacctatcctaccgagaacgaactaacgttacccaaacgtaacgaaccgtactaacggttactaccgtacggaacctaaaacgtacggaaaaccgtacgtacccgttagggaacgaacgtccggtacggaaacggaccgtaacggccgttaggttacgtaacggttacttgggtacgggaagtaaggtacggttgggaggttacggaagtttaggtacggttaaggg

SEQ ID NO: 272488 - DNA, 699 bp, Homo sapiens
  misc_feature: GYAE6OF02IE4T5.14.25.C03.1.454.CMB.1.raw
  modified_base (175)..(175): a, c, t, g, unknown or other
  misc_feature (175)..(175): n is a, c, g, or t
  modified_base (307)..(307): a, c, t, g, unknown or other
  misc_feature (307)..(307): n is a, c, g, or t
  modified_base (332)..(332): a, c, t, g, unknown or other
  misc_feature (332)..(332): n is a, c, g, or t
tcagcgtctagtaccacgaccggtgctcgatttagtagtgtagatttgggtttggggggagacgacgcccagcactggaagtcgccggtgtttccattcggtgatcagcactgaacacagaggactcaccatggagtttggctgagctggttttcctcgttgcgttcttttaagnggtgtccagtgtcaggtgcagcgtggtggagtcgtgggggagcgtggtccagccgtgggacggtcccctagacgtacctctcctggtgacctagtcccttgttaggtacttccgaccctttcacgttacctntcgcttagtgactacggcgggtccncccgtaggccctcgaggtcggaggggtctgggagtggtggctattatatcaactagtcgtagttacggaaactaagtacggacgttactacgtacggccccttaacggtcccggtaagggaaccggtccgtacgttaccgtaactacgtccgtaccgtaggtaacgtaactaaaccgttaccgaaaacgtaaccgtaccgtactaacgttacctcgtaccgaacgtaaacgtacgaacgtaccgtacgttagaacgacgtacgtacggaacgtacgaccgttacgtacggttacgttacgttacggtagggttaacgggagtaaggtggttacgggtacgttaggttaacgtttgttacggttaggg

SEQ ID NO: 272489 - DNA, 641 bp, Homo sapiens
  misc_feature: GYAE6OF02HA6OC.14.25.C03.1.454.CMB.1.raw
  modified_base (175)..(175): a, c, t, g, unknown or other
  misc_feature (175)..(175): n is a, c, g, or t
  modified_base (316)..(316): a, c, t, g, unknown or other
  misc_feature (316)..(316): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagnggtgtccagtgtcaggtgcagctgggtggagtcgtgggggaggcgtggtccaggccgtgggacgtccctggagacctctcctgtcgcagcctcgtggacttcctaccttcacgtacctatgctatgccacgtcgggtcccnccgacggtcctccgaggcggaggggtcgtgggaggttggggtggcgtaagttatactcgaactagtgagtacggaaactaaagtacgacgtcttagtcgacccgtaccgtccggtaggaaccgggtcctacgttccaacctactcctaccgagacgaactaacgtacccgaaagaaccgaacgacgtaagttactacgtacgtaacaaactacgaaacgacgtaccgtacgaagtacgctaggacggaccgacggtgttcggttagtacttacgtggggtaggagtaggtaggttagggacgttagtaagttaggttaggttagg

SEQ ID NO: 272490 - DNA, 818 bp, Homo sapiens
  misc_feature: GYAE6OF02HKKZO.14.25.C03.1.454.CMB.1.raw
  modified_base (158)..(158): a, c, t, g, unknown or other
  misc_feature (158)..(158): n is a, c, g, or t
  modified_base (702)..(702): a, c, t, g, unknown or other
  misc_feature (702)..(702): n is a, c, g, or t
  modified_base (720)..(720): a, c, t, g, unknown or other
  misc_feature (720)..(720): n is a, c, g, or t
  modified_base (733)..(733): a, c, t, g, unknown or other
  misc_feature (733)..(733): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttggctgagctgggttttccngttgcttcttttaagagtgtccagtgtcaggtgctagtctggtggacgtcgtgggggagcgtggtccaggccgtggggacgtccctagacgacttactccgtagtgcctacgtccttacgttagggtaacttacctaaacccgttttacgaaccgtttaacccgtaagttccggtaccgttaaacttcggaccttaaaccggttcggggttaccccgtacccggtaaacgggtcccttacccgggtaaacggggaccggggtaacggggggtcccttagggggtaacgggttcggggggtacggtaaccggttaaatttaacgtaaacgtccggtaaaacgaagttacgggaacgttaaacggggaaaacttaaaacgtacggaaccgttacttaacgcggtaacccgtacggttaccgggtaacgggaaccgggtaccgttacgttaacccgacctaaacgttcctaaccgtaagaacgtaactaaacgttaccaaacggtaaccacgtactaagttactacgtagaaacctaagacgtaacncggtacctagagtaacgngtaaggaacgacncggagttagttacgtcttaacggtggtaacgggtacgtaggtacggttaacgggtcggttaacgttaattacgggttagtacggg

SEQ ID NO: 272491 - DNA, 756 bp, Homo sapiens
  misc_feature: GYAE6OF02JCT78.14.25.C03.1.454.CMB.1.raw
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctctttaagaggtgtccagtgtcaggtgcagctggtggagtcgtgggggagcgtggtccagccgtgggacgtccctggacgactctcctgtcgcacgcctcgtggacttccaccttcagttacctatcgtctatgctacgtcgggtcccgacgacggcctcgagggccgggacggggtcctggggacgggttcggggtacggtacggttaatttaacgtacgtccgaacgtaggttaggtaagttaacgggtaaactttaaagacggtaaccgtacgttaaacgtccggaacccggtacgttacccgggtagggaaacgggtacccgtacgttacccgaacccgttaactcccgtacccgaacggtaacgtaacctaaacttaacccgaaaacgaaccgaacggtacgaacgttacgtacgacgtaacaaacgtaacggaaccaccggaccgttaggaacggtacgtaccgtacgggaacggtacgaccgggtaccgttaggttacggttaacgtttaaccggtaggggtacggggaagtaagggtacgggttagggtaaccgggttagtaaggttttaggttacgggttaaggg

SEQ ID NO: 272492 - DNA, 665 bp, Homo sapiens
  misc_feature: GYAE6OF02FO7EI.14.25.C03.1.454.CMB.1.raw
  modified_base (277)..(277): a, c, t, g, unknown or other
  misc_feature (277)..(277): n is a, c, g, or t
  modified_base (308)..(308): a, c, t, g, unknown or other
  misc_feature (308)..(308): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcacgcctcgtggacttccaccttnacgtacctatgctatgcaccgtcgggtcccncgaggcctccgaggcggaggggctgggaggtgggtggcgtattagtactcacagtggaagttaggaaacttaaagtaggaccgtcttaactcggcccgtaacttcccgggtaggaacggggtcccgtacgttaccaccctacttccctacccgaagaacgaacctaaacgttacccgaaaagaacctaccgacgtaagttactaccgtagaacctaaagtacgaaacgacgtacctaggacgacgtacgtaggaacggacgtaccgggcttacggtacgtttaacgttaccggttagggtacgggaagaaggttacggtacggggtaggtaaccggtagttacggtttggttaaggg

SEQ ID NO: 272493 - DNA, 615 bp, Homo sapiens
  misc_feature: GYAE6OF02H3VGE.14.25.C03.1.454.CMB.1.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (355)..(355): a, c, t, g, unknown or other
  misc_feature (355)..(355): n is a, c, g, or t
  modified_base (489)..(489): a, c, t, g, unknown or other
  misc_feature (489)..(489): n is a, c, g, or t
  modified_base (512)..(512): a, c, t, g, unknown or other
  misc_feature (512)..(512): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggacctcaccatggagtttgggctgagctgggttttcctcgttgcgttcttttaagaggtgtccagtgtcaggtgcagctggtgagtcgtgggggagcgtggtccaggcctgggagtccctgacgactctctgtncagcctntgattcacttcagtacctatgactatgcctacgtcgggtccactaggcctccggaggcggacggggctgggagggtgggtaggctaatttanagtcacagttgaattacgggaaactaagttagaccgtactagtcggacccacgttaccggtgaaaccgggcctagttcccaacctactctacccgaagtacgaacaacgttaccaaagtaaccacgactaagtnttacgagaacttaaagagaaacncgaccgtagaagagtcgtaggaacggtaccacgggtcgtaagttgttattacggtaggaagggtagaggtacggtcggtaggtataagttagtttaggtaggg

SEQ ID NO: 272494 - DNA, 798 bp, Homo sapiens
  misc_feature: GYAE6OF02JO0Q6.14.25.C03.1.454.CMB.1.raw
  modified_base (222)..(222): a, c, t, g, unknown or other
  misc_feature (222)..(222): n is a, c, g, or t
  modified_base (264)..(264): a, c, t, g, unknown or other
  misc_feature (264)..(264): n is a, c, g, or t
  modified_base (414)..(414): a, c, t, g, unknown or other
  misc_feature (414)..(414): n is a, c, g, or t
tcagcgtctagtaccacgaccggtgctcgatttagtagtgtagatttgggtttggggggaggacggagcccagcactggaagtcgccggtgtttccattcggtgatcagcactgaacacagagactcaccatggagtttgggctgagctgggttttcctcgttgctctttaagaggtgtccagtgtcaggtgcagctggtgagtctggggagcgttggtccngcctggggagtcccgtgagtactctcctagtcgcaagccctntggacttcgaccttcgagttaccgtatgtctatggtccaacgttgggtccccgccgaaggtcctaccgacgggcggaacgggggccttagggcggttgggtcggcgtaattagtaagtcccgactagtggtagtagggtaaaccttaaanacgggaacgtcttaacggtcggtaccccgagttaccccggtagggaaaacccggggtcccgtagtttacccgacccgtaacttaccccgttaccgtaacgggaaacgtaaaccgttaaaccgtttaacccggaaaacggtaaaacccaaccgggttaaccctaaacggtttaaacctcccgtttaagggtaccaaaaacgttaccgggaaaacccttaccggaacccgttaccgggaagtaaccgaccggttacggtaaaccgggaccgtaccggggttaccttacgggttacggttttaacggtttaacggtggggtttaacggggaacgtagggtaacgttcggggtaacggtacggttacgtttaggtttacggttagggg

SEQ ID NO: 272495 - DNA, 658 bp, Homo sapiens
  misc_feature: GYAE6OF02IXIM8.14.25.C03.1.454.CMB.1.raw
  modified_base (160)..(160): a, c, t, g, unknown or other
  misc_feature (160)..(160): n is a, c, g, or t
  modified_base (315)..(315): a, c, t, g, unknown or other
  misc_feature (315)..(315): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttccncgtgctactttaagagtcgtccagtgtcaggtgcagctggtggagtcgtgggggagcgtggtccaggcctgggagtccctgagactctctgtcgcagcctcgtggacttccaccttcgagtacctagtcgacttatggctacgttcggggacccnccgtaggtcctccggtagggccggaaggggcctggggacggttggggtacggcgtaagttatacgtcaagatggatagggaaacttaagtacgacgtactgtcgcccgagttccgtaggacggtccataccgactactcctcgaagacgtactaactacccgaaagaaccgagaccgtaagtacgtaccgtagaacgtaacgtagaaccgtacgtacgaggtaacgacgtcgtacggaacgtaccggtacgaccgttaggttacggttacgtttaacggtacggttagggaacggtaggttaggtacggggtaacgtacggttagttacggtagtttacgggg

SEQ ID NO: 272496 - DNA, 690 bp, Homo sapiens
  misc_feature: GYAE6OF02HQ3FB.14.25.C03.1.454.CMB.1.raw
  modified_base (348)..(348): a, c, t, g, unknown or other
  misc_feature (348)..(348): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttggctgagctgggttttcctcgttgctcttttaagaggtgtccagtgtcaggtgcagctggtggagtcgtgggggaggcgtggtccagccgtgggaggtcccctgacgactctcctgtgcagtcctcgtggattccaccttcacgtaccctagtcgactatcgctacgtgggtccgccaggtctccgaggcggagggctgggaggtgggnggtacgtattagtactacactatcggattacggaaactaagtaacggacgacgttatcggacccgtacgttcccggtagggaacgggtcccgtagttacccgaaccgttaactccgtacccgaaggtaacgtaaacctaaacgttacccaaaacggaaccgaacgtaccgtaacgttaactaccgtacggtaaccaaagttaccgaaaccgtaccggtacccgtaggaacgtacggccgtaaggacggtaaccgacgggttacgtaggttaccgtagttaaccggttcggtaagggtaacgaggtacggtagggtacggtacgtagtttacggttgttaggg

SEQ ID NO: 272497 - DNA, 796 bp, Homo sapiens
  misc_feature: GYAE6OF02HJW0S.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagaggtgtccagtgtcaggtgcagctggtggagtcggtgggggagcggtggtccagccgtgggacgtcccgtgagtactctccgtgtcgcacgcctcgtaggtactttcctaccttcgaacgttacctatcgactagtcgaccacggttcgggtcccgccgtacggtcctaccggaagggccgggaggggtctaggggtaggttcgggggtggacgttaagtttagtacgtccgtaactagttcggaattaacgggtaaaacttaaaggtaacgaccgtacgttacgtccggtaccccgtaacggttacccggtaaggggaaacccggggttcccgtaacgttacccaaccgtacttaccgtaccgaaagaacgtaacctaacgttaaccgaaaacgaacctaaccgtacgtaacgttacgtacgtacgaaacgaaacgttacgaaacgtacggtaccgtaaggaacggtaacgtaaccggtaacgggaaacggtacccgggtaacggtcgtttaacggttaccggtttaaacgttaccgggttaggggtaacgggtaaagggtacggtacgggttacgggggtaaggttccgttaaaggtttagtttaaggggtttcgggg

SEQ ID NO: 272498 - DNA, 596 bp, Homo sapiens
  misc_feature: GYAE6OF02IW8BA.14.25.C03.1.454.CMB.1.raw
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (516)..(516): a, c, t, g, unknown or other
  misc_feature (516)..(516): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcggtcgtttcgcgtaggcgtcttaagtaggtgtcagtgtcaggtgcagtctggtggacgtcgtggggagcgtggccagcctgggacgttcccnggagacctctcctgtancgancctnggtatcacttnacgtactatgctatgcacgtcggtcaacgnggtccncgaggcggagggtctaggagtgggtgcgtaattncttanactgtacgagttacgaaattacgtagactctagtcgaactcgttcggagacggtccattccaactctcncgagactanacttacgaaacgtacncgactaacgtntaccnggacagtacgaacncgtacgtaggaagtcgacggtgaaacggtcaaccgggtttntaggttacgttcgttacggttaggtacgggtagacggttacggtacgggttacgttacggtaagtttgggttaggtcggg

SEQ ID NO: 272499 - DNA, 582 bp, Homo sapiens
  misc_feature: GYAE6OF02FF814.14.25.C03.1.454.CMB.1.raw
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggtttttcctcgttgctcttttaagaggtgtccagtgtcaggtgcagctggtggagtctgggggaggcgtggtccagcctgggagtccctgagactctcctgtgcacgcctctggattcaccttcagtacctattgctaagtgctacgtgggtcccgccaggcctccgaggcgaggggctgggagtgggtggcgattanatcacatgatggaaactaanagacgctaagcgcctacgtccgtagaacgggccagttaccgacctatcctaccgaagacgaactaattacccaaagaaccacgacaagtactcagacaaatacgaacacgcctagagacgcgtacgaggacgacggtcaggttagtaacttacgtagggttagggaacgtaggtacggtggggtaacgttcgggtattacggtttggttaggg

SEQ ID NO: 272500 - DNA, 687 bp, Homo sapiens
  misc_feature: GYAE6OF02I75OS.14.25.C03.1.454.CMB.1.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagactctcctgtgcagcctctggacttcaccttcagtacctatgactatcgcacgtgggtacccncgaggcctcgaggcggaggggctgggagtggggtcgcgtaattanaactcaactagtcgaatacgggaaactaaagtacggactctaagtcggacccgtacgtccggtagggaaacgggtccgtaacttaccgaacctacttcccgtaccgaagaacgtaaacctaaacttaaccgaaaacgtaaaccgaacccgtactaacggttaactaccgttacggaaactaaaacgtacggaaaaccgtacggtaccctaggaacgacgtacgtaacggaacggtaaccgaccggtcgttaggttacgttaacgttaaccggtgggtaacgggaagtaacggtaacggtaggtaacggttacgtaagtttacgttaggttaacggg

SEQ ID NO: 272501 - DNA, 657 bp, Homo sapiens
  misc_feature: GYAE6OF02GFKE1.14.25.C03.1.454.CMB.1.raw
  modified_base (159)..(159): a, c, t, g, unknown or other
  misc_feature (159)..(159): n is a, c, g, or t
  modified_base (177)..(177): a, c, t, g, unknown or other
  misc_feature (177)..(177): n is a, c, g, or t
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (544)..(544): a, c, t, g, unknown or other
  misc_feature (544)..(544): n is a, c, g, or t
tcagcgtctagtaccacgaccggtgctcgatttagtagtgtagatttgggtttggggagacgagcccagcactaggaagtcgccggtgtttccattcggtgatcagcactgaacacagaggactcaccagtggagtttgggctgagcttgggttttccncgttgcttacttttaagnggtgtccagtgtcaggtcgcagctggtggacgtcgtgggggagcgtggtcccagtccgtgggacgttccctgacgtactctccgtgtcgcagtcctgtggacttcacccttgacgtaacctattcggcttagngacctacggtggtcccgacgaggtcctaccgagggtaccggaggggtctaggggaggtacggggttcggacttagtttanactacgactaagttcggaatacggaaactaatcgggactctaagtcgaccgtaacgtccgtaggaaaggtccgtagttaccacgtacgtcctacgaagacaacgtaacttaccgaaagtaaccgacgacgaagtactacgtagaaaccttaaanaacggtaacacggtaccgtaggaacgaacgtcgtaggaacgtaccgacgtagtacggtatacgttaacgtggagggtagaagtaggtggacggtacgtagttagtggtaacgg

SEQ ID NO: 272502 - DNA, 678 bp, Homo sapiens
  misc_feature: GYAE6OF02HH6SB.14.25.C03.1.454.CMB.1.raw
  modified_base (159)..(159): a, c, t, g, unknown or other
  misc_feature (159)..(159): n is a, c, g, or t
  modified_base (329)..(329): a, c, t, g, unknown or other
  misc_feature (329)..(329): n is a, c, g, or t
  modified_base (416)..(416): a, c, t, g, unknown or other
  misc_feature (416)..(416): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttccngttgcttctttaagaggtgtcagtgtcaggtgcagcgtggtggagtcgtgggggagcgtggtccagccgtggggacgtccctggacgacctcctccgtggtacgcacgcccttgtggtattccaccttcgacgttaacccttagtcgctatgacctacgtcggggtcccnccgaggccctacgagggcggaggggtctaggggaggtggggtcggacgtatttatatccacagtgaataggaactaagtacgacgtntacgtcgcccgtacgtccggtaggaaccgggtccgtacttcccgactacgttcctaccgaagactaacgtaacttaccgaaacgaaccgtaccgataacgtactctacgtaacaaacgtacgaacacgtacgtaggaggacgtacgacggaacggaccgtacgggcgttacgtttaggttaaccttacggttagggagggtaacggtaggtagggttacggggtaacggttacggtaaggtttaggtttagggttaacgggg

SEQ ID NO: 272503 - DNA, 764 bp, Homo sapiens
  misc_feature: GYAE6OF02F3VMD.14.25.C03.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (322)..(322): a, c, t, g, unknown or other
  misc_feature (322)..(322): n is a, c, g, or t
tcagcgtctagtaccacgaccggtgctcgatttagtagtgtagatttgggttggggggagacgagcccagcactggaagtcgccggtgtttccattcggtgatcagcactgaacacagaggactcaccatggagtttgggctgagctgggttttcctcgttgctcttttaagaggtgtccagtgtcaggtncagctggnggagtcgtggggagcgtcggtccagccgtgggacggtccctgacgactctccgtgtgcagcctcgtggtattccacctttcgacgttacctaatcgctaagtcgaccacggttccgggtcccnccgaacgggcctaccgagggcgaagggggcctaggggtagtcggggtagcgtaggttcggtggtagggtacgtagggtaacgggaaacgttaagtaacggtaaaacgttgacgggaccctaaccgggtccggtaaacgggaacggggtcctaaacgtttacccgacccgtaacctccgtaccgaaacgtaacgaaactaacttaacccgaaaactaacgtaattacgttacgttaactaccgtacgtaaacgaaattacggtaaaacgtacgtacccgttaggaaggtaaccgggaaccgggtaaccgaaccgggtaacggtcccgtttaggttaaccgttattaaccgttacgtaggtaacgtaacggacggttaagggtacgggggtaggggtttacggtaacggtacccggtaaccggtagggttacgtacggttaagg

SEQ ID NO: 272504 - DNA, 666 bp, Homo sapiens
  misc_feature: GYAE6OF02IXSZ6.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggacgtccctgagacctctcctgtgcagcctcgtaggattccaccttcagtaccctatgctatgcctacgtcggggtcccgccagggcctaccggagggccggacgggggtcgtgggaggttggggtggcgttagttatagtccaatagtgtaagtacggtaaacttaagtacggacgtactagtcggtccctaccgttccggtagggaacgggccgtacttcgaaccctgtacctaccgaagacggaactaacttaccaaacggaactaccgacgtagtactacgtacgaacaagtacggaaacctcgtaccgtaggacgtacgtcgtaacggacggaccgtacggtcgtaggttacgttaacgttacggtagggtaggggtaagtaggacggtacggggtacgttacggtaagttaggttagggttagggg

SEQ ID NO: 272505 - DNA, 609 bp, Homo sapiens
  misc_feature: GYAE6OF02INJ2I.14.25.C03.1.454.CMB.1.raw
  modified_base (160)..(160): a, c, t, g, unknown or other
  misc_feature (160)..(160): n is a, c, g, or t
  modified_base (354)..(354): a, c, t, g, unknown or other
  misc_feature (354)..(354): n is a, c, g, or t
  modified_base (439)..(439): a, c, t, g, unknown or other
  misc_feature (439)..(439): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagctgggttttccncgttgctcttttaagaggtgtccagtgtcaggtgcagctggtggagtcgtgggggaggcgtggtccagcctgggagtccctgagactctccgtgtcgcagcctctggattcacctttcagttacctatgctatgcacgtcggtccgccaggcctccgagggcggaggggctgggaggtggggtcggcgtattanacgtacactagtacgagtacggaaactaagtacgacgcttagtcgaccgtacgtccggtaggaacgggccgtattccaccatccnccagacgaactaactaccaaagaacacgactaagtatctagacaagtacgaacagtacctaggacgacgtcgtaggaacggacaccgggagttggtagttacgttacggtgggtagggaggtaaggtcgtacggggtacggtacggtaagttacggttaggttaacgggg

SEQ ID NO: 272506 - DNA, 710 bp, Homo sapiens
  misc_feature: GYAE6OF02JFG02.14.25.C03.1.454.CMB.1.raw
  modified_base (355)..(355): a, c, t, g, unknown or other
  misc_feature (355)..(355): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccaggccgtggggagtccctggagactctcctgtgcagcctctggattccaccttcgagttacctatgtctatcgcctagtcgggtcccgccgaggcctaccggaggcggaggggtctgggaggttcgggnggacgtaagtttatagtcgaactcgtaggtagttaagggaaactaagtacggaccgtacgtagttcgacccggtaaccctccgggtagggaaacccgggggtcccgtaacgtttcccgtaacccgtaccttacccgttacccgacggtaacgtaaacctaacgttaacccgaaaccgaaaccgaaccgtacgaacgttaactacctacgaacgtaaaactagaaaccacgtacgtacgaagacggacgtaggacggaccgtacggtcgttggttacgttaacgttacgttacggggtagggtaacgtaggtacgggttagggtacggttacggtaagttacgtttagggttaggg

SEQ ID NO: 272507 - DNA, 702 bp, Homo sapiens
  misc_feature: GYAE6OF02F4TVZ.14.25.C03.1.454.CMB.1.raw
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggacttcaccttnagtacctatgctatgcacgtcggggtccnccaggcctccgaggcggaggggctgggaggtgggtggcgtattanatcacatgagtggaactaagtacgacgtctaagtcggacccgtaccttccggtaggaaacggggcccgtaactttaccgaccctattcccgttaccgaaggtaacgaacgtaacttacccgaaacgtaaacccgtaccgaccgtaaacgttaactaccgttacggaaccaaaacgttacggaaaccgtacggtacccgttaggaaccggaacgtaccgtacggaacggaaccggtaccgggtacgttacgggttaacggtttaacgtttaaccggttaggggtaacggggtaacggtaaggtaacgggttagggggtaacgggttaacggtagtttaaggtttgggtttaacggg

SEQ ID NO: 272508 - DNA, 874 bp, Homo sapiens
  misc_feature: GYAE6OF02JY07A.14.25.C03.1.454.CMB.1.raw
  modified_base (175)..(175): a, c, t, g, unknown or other
  misc_feature (175)..(175): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctgttgcttgttttaagnggtgtccagtgtacaggtgcagctgggtgacgtcgtggggggagtcgtggtccgagccgtgggacgttcccgngacgaccttctccgttggngcctaaggtccctcgtggtacttcctaaccgttcaacggttacctattacggccttaatccggaccgtacggtccgggtacccgaccggacggtcctacggaaggtcccggggaaggggtccggttgggaccgggtttgggggtaccggtcgggttaacttaagtctaaccgtaacgtacgtaccggtaaggtttgaaaacgttacgtaaacgggtacgtaccggtaaggttccaccggtaacccgtttcccggggaagggtaaacgggtacccggtaaccgtttacccgggaaacccttaaccttaccggtaaccggtaaacggaaaccggttaaaacccgaaactttaccccgaaaaaccgggtaacgtaaacccggtacccggtaaagttacccggtttaagaccggtaaaacctaaccggttaaactaacccggaaccgtcccgggttaagaaccgggtaacgtaccggtaacggaacggttaacgtaccgggtaccgttagggttaacggttacggttaaccgtaggggtaacgggtaacggttaggtaacggggttacgggtaacggttaaacgttacggtttaacggttggggtaacggg

SEQ ID NO: 272509 - DNA, 883 bp, Homo sapiens
  misc_feature: GYAE6OF02GEIUM.14.25.C03.1.454.CMB.1.raw
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggacgtcctgagctctcctggtcgcacgtcctcgtggtacttcctacccttgacgtacctatcgactatcgacctacggtcgggtcccgccgagggtccctccggacgggcgggaggggtcgtaggggtacgggtgggggtcggtacggtaacttttaagtaaccgttaccgaacgtaaggttagggtaacgttaaacggggtaaaacctttaaagggtaaccggtaccgtacgttaacgtcccgggtaccccggtaacccggtttacccggggtaaccggggtaaccgggggtaccccgttaaacgtttccccgaaacccgttaaccttaccccgtaaaccggtaaacggtaaaccggtaaaaccctttaaacccggttaaaaccccgaaaacgaaacccggttaacccgtaaccggttaaggttaaacccgttaccgtaaccggtaaaccgttaaaacgttccggaaaacccggtaccgtacccggtaaggggtaacgtaccggtaacgtaacggggaaacggtacccggtacgggttgttaacggtttacgttaaccggtttcgggttacgggtaacgggtaaggtaagggttacgggttacggggttaaacgggttaacgttaggttttaaccggttgggtttaagggggg

SEQ ID NO: 272510 - DNA, 849 bp, Homo sapiens
  misc_feature: GYAE6OF02H5OKR.14.25.C03.1.454.CMB.1.raw
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
tcagcgtctagtaccacgaccggtgctcgatttagtagtgtagatttgggtttggggggggagacgagcccagcactggaagtcgccggtgtttccattcggtgatcagcactgaacacagaggactcacatggagttgggctgagcttgggttttcctcgttgcttacttttaaggaggtgtcagtgtcgaggtgcagcgtggtaggagtcgtgggggagcgtggtccaggccgtgggacgtcctgacgacttctccgngtgccagtcctgtaggctttaccgaccttnaacggtccttagtggtcttagtcggacctaggttccgggcccgacgacggtcctacccggaggccgggtaaggggtccgtaggggtacgggttgggggtacggaccgttaaagttttagaaccgtccgtaaaagtggttgggtaaaccgttaacggggtaaaactttaaacgacgggttaccgacgtttaggaccgggccccttaaacccggtttcggggaacgggaacccggggtttccgtaacgttaccctaaacccggtaccgtttacccgtaacccggtaaagggaaaccgttaaaccgggtaaaaccctttaacccgtaaaaccgggaaaaccgtaaccgggttaaaccgtaacgttaacgttaacgaccggtaaaacgtaaacgttaccggaaacgtacccgttacggaacggtacggtaacgcggtacggaacgggaacgtaccgggtagttacggttacgttaccggtttaaggtacgggttaacggggtaaaggtacggttagggtacccgggtaaggtaccggttaagttacggtttggggtttagggg

SEQ ID NO: 272511 - DNA, 887 bp, Homo sapiens
  misc_feature: GYAE6OF02HNAK5.14.25.C03.1.454.CMB.1.raw
  modified_base (180)..(180): a, c, t, g, unknown or other
  misc_feature (180)..(180): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctgttgcttcttttaagaggtntccagtgtcagggtgcagctgggtggagtcgtggggggagcgtggtcccaggcccgtggggacggttcccctggacgaccttcttcctggtacgccaggcccttgtggactttccaacctttccgaagttaccctatcgacttatcgacgtacgtcgggtcccgccgacgggtccctccggaaggggccggaagggggtcctaggggtacggttgggggacggtaccgtaattttacgaacgttaccgaaccgtaagttggaaactttaacggggaaacctttaaacggtaaccggaacccgttagttaaccggtaccgggtaccccgtaaaccgggtttcccgggtaaagggaaacccgggggtaccgttaaccgtttaacccgaacccgttaaccgtttccccgtaaccgaaacgggtaaaccgtaaactaaaccgtttaaacccgaaaacggaaacccgaaccggttacgaaacgtttaaccgttacccggtacgaaccgttaaaagtaaaccggaaacccgtacggtaccgttaacgggaacgtaccgggtaagttaccgggaacgggtaacccgggacgggttaccgttaggttttaaccggttaagtttacccggggttagggttaaggggaagggttaaggtaacgggttaggggtaaaggtttaacccgggtaagttttagggttagggttaacggggg

SEQ ID NO: 272512 - DNA, 673 bp, Homo sapiens
  misc_feature: GYAE6OF02FO2GI.14.25.C03.1.454.CMB.1.raw
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtggggaggtccctgacgactctcctgtgcagcctcgtggattccacctttcacgttacctatgactatgccacgtgggtcccgcgaggcctccgagggcgaggggctgggaggtgggtggcgattanatcacatgataggaactaagtagacgntagtcgcccgtacgtccggtaggaacgggccgtacttccgaacctactcctaccgaaggacgaaccgtaaacttacccgaaacgtaaaccaccgacgtagttaactcgtagaccaaacgtagaaaccgtacgcccgtaggaacgacgacgtaacggacgggaaccgaccgggtcgttacggtttacggtttaacgttaaccgggttagggttagggggaacggtaacgggttaaggttacgggggtaacgggttacgggttaagtttacgggtttaggtttaaggggg

SEQ ID NO: 272513 - DNA, 753 bp, Homo sapiens
  misc_feature: GYAE6OF02GOI8J.14.25.C03.1.454.CMB.1.raw
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagcctgggagtcccngagactctcctgtgcacgcctcgtggacttccacctttcgaagttaccctatcgcttatcgcctacgtcggggtcccnccgagggtcctccgagggccggacgggggcttggggaggttggggtacggacgttaagtttatactccgaacgtagttaggaagttagggaaaacttaaagtacggaaccgtacttaacgtcggaccccgtaacggttcccgggtaagggtaaaccgggggtcccgtaacgttacccgaaccttaaccgttcccgttaaccgaaacggtaacgtaaacctaaacgttacccgaaaacgtaaacccgaacggaccgtaagttactacgtacgtaaccgtaaacgtacggtaacgacgtccgtagggaacgacggtacgtaggaacggaccgtacgggtccgttaggttacgttaacgtttaccgggtagggtaacggggaaggtacggtagggttacggggtaaggttaggtaagtttaggttaggttaacgggg

SEQ ID NO: 272514 - DNA, 775 bp, Homo sapiens
  misc_feature: GYAE6OF02GJPTX.14.25.C03.1.454.CMB.1.raw
  modified_base (158)..(158): a, c, t, g, unknown or other
  misc_feature (158)..(158): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttccncgttgctcttttaagaggtgtccagtgtcaggtgcagctggtggagtctgggggagcgtggtccagtccgtggggacgtccctgagtactctcctgtagcagtcctacgtggattccgacctttcagtaccctatcgcttatgactacgtggggtcccaccagggtcctacgaggggccgagggggctaggggaggtcggggtcggccgtaatttagtacgtaccaacgtaacttggaaacgttacgggtaaacctttaaaggttacggaaccgtcttaaacgtccggaccccggtaaccgttcccgggttaaggggaaaccggggcccgtttaacgtttcccgaaacccgttaggttaccccttacccggaaacggtaaccgttaaaacccttaaaccgtttaccccgaaaaacggtaaacccgaaccgggttaaccctaagggtttaactcccggttaacggaaactaaacggttagaaaccggacgttaccgagtacggtaacggtctaagggaccggaacgtacggtccttaggttacggttaacttacgtagggaacgggttaggaagttaccggtggggtaccgtaggttaagttaggttagggttaaggg

SEQ ID NO: 272515 - DNA, 710 bp, Homo sapiens
  misc_feature: GYAE6OF02G2538.14.25.C03.1.454.CMB.1.raw
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtgagtcgtgggggagcgtggtccagccgtgggacggtccctgacgactcctcctgtgccagcctcgtggacttccaccttnacgtacctatgctatgcacgtcgggtccncaggtctcgaggcgaggggctgggagtgggtcggcatttacgactccanagttgagtaggtaaacctaagtacggactcgttaanccggacccgtaacgtcggtagggaaaccggggtccgtacttaccaaccctacgttcccgtaacccgaggtaaaccgtaacttaaacgttaacccgaaaacggtaaaaccgtacccgtaaacgttaaacggttaaccttcgtaacggaaacctaaaagtaccggtaaaaccaccggttacccgtagaacggtaagtccggtacgggtaaacgggacccgtaccgggttacgttaggttacggtttaacgttacgggtgggttaagggaacggtaaggtacggtagggtacggttacggtaatttggtaggttaggg

SEQ ID NO: 272516 - DNA, 886 bp, Homo sapiens
  misc_feature: GYAE6OF02JZ00R.14.25.C03.1.454.CMB.1.raw
  modified_base (205)..(205): a, c, t, g, unknown or other
  misc_feature (205)..(205): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggtttcctcgttgctacttttaagaggtgtccagtgtcaggtgcagctgggtggngtcgtgggggagcggtggtccaggccgtggggagtccctggagtactcgtcctgtcgcacgcctcgtggacttccgaccttcacgttacctagtcacttagcgtcctacggtcgggtacccgccgacgggtccttaccggagggtcgggtaacgggggtcgttagggggtaacgggtcgggggtacggtaagttaactttacgtaaccgtacgtaaaccggtagtacggttaacggtaaaccggggttaaaactttaaacggtacgggtaacccgtaacgttaacgtccggggttaaccccgtaaccgggtttacgggaaacggggttaacccggggtacccgtttaaccgttaccccgtaaccgtaaccgttttaccccggtaaccgtaaacgggtaaaccgttaaaccgttaaaccgtttaacccgaaaagtaacccgtaacccgacgttaaacgttacgttaccggaacgtaaaccgtaaaacgttaaccggaaacgtaccggtaaccgtaacgggaacgttacggaaccgttacgggaaacgtaacccgggtacggttaccggtaggtttaaccggttaaccggttaacggtacggggtaccgggttaaagggtacgggttaaggtacccgggggttaaggttaacggtagggttttagtttaacgggttaaggggg

SEQ ID NO: 272517 - DNA, 723 bp, Homo sapiens
  misc_feature: GYAE6OF02F7A3T.14.25.C03.1.454.CMB.1.raw
  modified_base (159)..(159): a, c, t, g, unknown or other
  misc_feature (159)..(159): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttccncggttgcttcttttaagaggtgtccagtgtcaggtgcagctggtggagtcgtgggggagcgtggtccagccgtgggagtccctgacgtactcgtccgtgtgcacgtcctgtggacttccaccttcagtacctatcgctatgctacgtcgggtccaccgaggcctacgacgggcggacggggcgtagggaggttggggtggacgttatttaactacgtccaatagttaggagttaacggaaacttaaagtacggaaccgtcttaaggtccgacccgtacgttcccgggtacgggaacgggtaccgtactttacccgaacgtacgtccgtaaccgaagaactaacctaaacgttacccaaaacgggtaaccaccggtactaaacggttactaccgtaagaaccttaaagtaccgaaaccgtacgtaccgtaggaaggtaacgtcgacgggtaaccggaaccgtacgggttacgttacggttagttaaccggttacggtacgggtaacgggtaggaaggttcgaacggggttacggtacgttaacgtttacggtttggttaacgggg

SEQ ID NO: 272518 - DNA, 629 bp, Homo sapiens
  misc_feature: GYAE6OF02F81AK.14.25.C03.1.454.CMB.1.raw
  modified_base (196)..(196): a, c, t, g, unknown or other
  misc_feature (196)..(196): n is a, c, g, or t
  modified_base (431)..(431): a, c, t, g, unknown or other
  misc_feature (431)..(431): n is a, c, g, or t
  modified_base (513)..(513): a, c, t, g, unknown or other
  misc_feature (513)..(513): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttcgggctgagcttgggttttcctcgttgcttcgttttaagaggtgtccagtgtcaggtncagctggtggagtcgtgggggaggcgtggtccaggccgtgggaggtccctgacgactcctccgtgtcgcacggtcctcgtggtacttccacccttcgacgttaacctaagtgtcctagtgaccgtacgtcgggtcccgaccgagggcctccggaaggggtcggaggggtctgggaaggtggggcggacgtatttatactacgactagtagacgtaggtaaactaagtacgcgtanacgtcgaccgtactcggtaggaacggtccgattaccgaaccatcctacaagacgaaactataaccgaaatacacgctaagtnacgtgaactaagtacgaacgacgtccgagacgtagacgtacggaacgacgtacgtactgtacgtagttcgtagggtacggagtaagtcggtaggtaggtatacgtagtggttaggg

SEQ ID NO: 272519 - DNA, 800 bp, Homo sapiens
  misc_feature: GYAE6OF02IC7JJ.14.25.C03.1.454.CMB.1.raw
  modified_base (202)..(202): a, c, t, g, unknown or other
  misc_feature (202)..(202): n is a, c, g, or t
  modified_base (326)..(326): a, c, t, g, unknown or other
  misc_feature (326)..(326): n is a, c, g, or t
  modified_base (376)..(376): a, c, t, g, unknown or other
  misc_feature (376)..(376): n is a, c, g, or t
  modified_base (452)..(452): a, c, t, g, unknown or other
  misc_feature (452)..(452): n is a, c, g, or t
tcagcgtctagtaccacgaccggtgctcgatttagtagtgtagatttgggtttgggggggagacgagcccagcactggaagtcgccggtgtttccattcggtgatcagtcactgaacacagaggactcaccgatggagtttgggctgacgcttagggttttccctgttgcttcgttttaaggaggttgtccagtgtcaggtnctagcttgggtggagttcgtaggggggagtcggttacggtcccaggtcccgtaggggaccggttccctaggaacgcttaccggttccttggcggaccagtccttgttagctttccaccgttttnaacgttacccttagcgtactaacgtcggaacctacgggttcgggtacccncccgtaaggtcccttaccgggaggaccgggagggggtacttggggaggttcggggtacggtaacttagtttaacgnttacgaaacgtagttcggaacggtttagggaaaaacctaggtcgggtaccgaaacttgtaaccggcccgttaacggtttcggacggggtaacggaccgttacgtaacctaaccgtacgtaccgtaccggtaacgtaaacgtaacgtaaacctaaccgtaaacgtaaccgtaaccggactaacgtaactcgttacgaacttaaacggtcgaaacgttacgaccgttaggaacgaacggttaacacgggaacgtaccgtacggtacgttaccgtttagttaacgttaccggtaggtaacggagtaacggttacggaggtaccggtacgtaatttacggtggttaaccggg

SEQ ID NO: 272520 - DNA, 724 bp, Homo sapiens
  misc_feature: GYAE6OF02I5BWT.14.25.C03.1.454.CMB.1.raw
  modified_base (272)..(272): a, c, t, g, unknown or other
  misc_feature (272)..(272): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtcctgagactctcctgtgcagcctctggattccaccttnagtacctatgctatcgcacgtgggtccctaccaggtcctccgaagggccgaggggctagggngtgggggtgacgtatttaanactcgaacctagtcgaagtgggaaactaagtagacgtcttaagtcgaccgaccgtccggtagggtaaacggggacccgtatttacccgaaccgtacgttaccccgtaccgaacggtacgaaaccgttaaacgttacccgaaaaggaaaccttaacggaacccaacggtttaacctaccgttacggaaacctaaaagggttaacgaaaccgtaaccggaccgttaaggaacggtacgtaaccgttcgggaaacggaccgtaacgggtcctttacggttaaggttaacctttaaccggttggggttaacggggaacgtaagggttaggtacggggtaagttaaccgggtaagtttacggttggtttaagggg

SEQ ID NO: 272521 - DNA, 685 bp, Homo sapiens
  misc_feature: GYAE6OF02GTDTH.14.25.C03.1.454.CMB.1.raw
  modified_base (157)..(157): a, c, t, g, unknown or other
  misc_feature (157)..(157): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttggctgagctgggttttccncgttgcttcttttaagaggtgtccagtgtcaggtgcagctggtggagtcgtagggggaagcgtggtaccaggccgtggggacgtccctggacgtacctcctcctgtcgcagtccctcgtggtacttccaccttgtaacgttaccttagtgacttagtcgacctacggttccgggtcccgaccgacggtcctaccggaggggcgggacggggtctaggggtacgggtggggtcggacgttaacttatactcaacgtagtggtaacgtaaggtaaaactagtacgacgtactagtcgacccgtcgtaccggtaggaaccgggtccgtacttaccacctacgtacctaccgaagtaacgaacttaactaccgaaacgaaccacgtactaagttactacgtcgaaactaaacgtacgaaacgtcgaccgtagaacgacgtgtacggaacggaccgacggtcttaggttacgttacgttaacggtggtaagggagtaggtagtgggtaacgtgttaagttcggttaggttagg

SEQ ID NO: 272522 - DNA, 728 bp, Homo sapiens
  misc_feature: GYAE6OF02HAGDN.14.25.C03.1.454.CMB.1.raw
  modified_base (158)..(158): a, c, t, g, unknown or other
  misc_feature (158)..(158): n is a, c, g, or t
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (174)..(175): a, c, t, g, unknown or other
  misc_feature (174)..(175): n is a, c, g, or t
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (578)..(578): a, c, t, g, unknown or other
  misc_feature (578)..(578): n is a, c, g, or t
  modified_base (685)..(685): a, c, t, g, unknown or other
  misc_feature (685)..(685): n is a, c, g, or t
tcagcgtctagtaccacgaccggtgctcgatttagtagtgtagatttgggtttgggggggagacgagcccagcactggaagtcgccggtgtttccattcggtgactcagccactgaacacgagacggacctcaccatggacttggctgagcgtgttcntagctcttagngtncnngcngtncagctggtnacgtcgnggggancgtcgcngccgtgggactccgnggaccactcctacgtgtcgctacgcttcgcgtattccacgtcacgtcgtatcgcgtacncgtccaggttcggtacccgcacggggttcacggcggtacggcggctagggagtcgggnganaacggttcaagtccgtaacnggaacaccggtaacgaaacgtacgtaacggtaaaccgtcgtttaagcccccgggttacgttacccgggtaccggtaacgggtaaccccgggttatacccgttaccgtaacccgtaacctttaaccgggtaacccgagggtaaacccgtaacgttaaaccggttaaaccccgaaaagtaacccgggttaacgtaccggttaacttacggttacnccgggtaactaaggaaacccgttagttaaccgcgaaccgtaacacggtttacgggaacgaccgttacgccgttacgttacgtagtttaccggacgttgggttaacgngtaacggagtccggtaaggaccgttaagttcgttggttaacgg

SEQ ID NO: 272523 - DNA, 734 bp, Homo sapiens
  misc_feature: GYAE6OF02GJQRX.14.25.C03.1.454.CMB.1.raw
  modified_base (158)..(158): a, c, t, g, unknown or other
  misc_feature (158)..(158): n is a, c, g, or t
  modified_base (403)..(403): a, c, t, g, unknown or other
  misc_feature (403)..(403): n is a, c, g, or t
  modified_base (648)..(648): a, c, t, g, unknown or other
  misc_feature (648)..(648): n is a, c, g, or t
tcagcgtctagtaccacgaccggtgctcgatttagtagtgtagatttgggtttggggggagacgagcccagcactggaagtcgccggtgtttccattcggtgatcagcactgaacacagaggactcaccatggagtttgggctgagctgggttttccncgttgctcttttaagaggtgtccagtgtcaggtgcagctggtcggagtcgtgggggaggcgtggtccaggcctggggagtccctggacgactctcctggtcgcgagccctcgtggaactttccgaacccttcagttaaccctattcggaccttagtcggacacgttggggtcctcgacccgacggtccttccggaagggcggtaacggggtcgtgggagggttcggggtcgggacgtaagtttanacttacgaactagtcggaaacgtttacgggaaaacttaaacgtacggaacgtacctaagttacggacccccggaagtttcccgggaagggaacccgggtccgtacgtttaccaacctacttcccacgtacgaacggtaacctaacgttaacccgaaacgaaccgacgacgtaagtacgtactacgaacgtaaatacgaaacctacggtacctagaacggtacgacgacgtacgaccgtacgggtntaaccggtttaagtaaccgttacggtagggtacgggaaaggtacggtaacggttacgggtacggtaccggtaggttagtttacggg

SEQ ID NO: 272524 - DNA, 802 bp, Homo sapiens
  misc_feature: GYAE6OF02GXXJN.14.25.C03.1.454.CMB.1.raw
  modified_base (177)..(177): a, c, t, g, unknown or other
  misc_feature (177)..(177): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttcttttaagnggtgtccagtgtcaggtgcagctggtggagtcgtgggggacgtcggtggtccagccgtgggacgttccctgagactctcctgtgcgagcctctggacttccaccttcaacgttacctatgctagtcgccgtacgtcgggtcccgccgtacggcctaccgagggccgggacgggggtccgtggggtagggttcgggggtcgggacgttaagtttataacgttccgaaacgagtttaggaacgtttaacggggtaaaaccttaagtttacggaaccggtacttaacggtccggaaccccgttaaccgggttcccggggtacgggaaacccggggttccgtaaccgtttaccgaacccgtacttaccccgtaacgtaaccggaaacgtaaacccgtaacgttaacccgaaaacggtaaccgaacccgtaccgtaagttacccgttcgtacgtaaacgtaaacggtaagaaacccgacgtacccgtaaggaacggtaccggtcggtaacggaaaccggtacgaacgggttccgttcgttaacggtttaacgttaccggttagggtacgggtaaggtacggtaacgggtcgggttagggttaacgttagtttaggtacgggtttaagggg

SEQ ID NO: 272525 - DNA, 679 bp, Homo sapiens
  misc_feature: GYAE6OF02GQ4Y3.14.25.C03.1.454.CMB.1.raw
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
  modified_base (377)..(377): a, c, t, g, unknown or other
  misc_feature (377)..(377): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggtttcctcgttgctctttaagaggtgtccagtgtcaggtgcagctggtggagtcgtgggggaggcgtgggtccagccgtggggagtccctgacgactctcctggtncagcctcgtggattcacctttnagtacctatgctatgcacgtgggtcccncgaggcctccgagggcgaggggctgggaggtgggtggcgtattanagtcactatgagtaggaaacttaanagacgctaagtcgaccgtactcggtaggaacgggcccgtacttacccgaaccgtacttacctaccgaagtaacgaactaaacttaccgaaaacgaaaccgacgacgtaagttaacttacgtacgaaactaaacgtacggaaaccgtacgtaccggtagaacggacgtacggtaacggtaacgggaaccgtaccgggtacgttaggttacggttaacgtttaacggttacggggtaagggaaggttaggtacgggttaggggtaagggttaccggtaagttttacgggttaggtttaacgggg

SEQ ID NO: 272526 - DNA, 544 bp, Homo sapiens
  misc_feature: GYAE6OF02H4SZ5.14.25.C03.1.454.CMB.1.raw
  modified_base (160)..(160): a, c, t, g, unknown or other
  misc_feature (160)..(160): n is a, c, g, or t
  modified_base (181)..(181): a, c, t, g, unknown or other
  misc_feature (181)..(181): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
tcagcgtctagtaccacgaccggtgctcgatttagtagtgtagatttgggtttgggggggaggacgagcccagcactggaagtcgccggtgtttccattcggtgatcagcactgaacacagaggactcaccatggagtttgggctgagctgggttttccncgttgctacttttaagaggtntcagtgtcaggtgcagcgtggtggagtcgtagggggagcgtggaccagctgggagtcctgagctgtcctgtagcagcctntgatcacttnagtactngctangnactgggccncagctcgagcgaggctggagtgagcgattagntcacatggaatggaaacagtacggacacggtntacgccgaacttccggagagggacccgattcaactcactccaagngtaaccaattcaaanaacgttacgaacgtatcgngtacaaatcgaaacngttcagagcgatnaggttacacgcgtaggtanccttaagnggttaaccggaagngttaaccgggnggtacggtactagttacgtggttacgg

SEQ ID NO: 272527 - DNA, 760 bp, Homo sapiens
  misc_feature: GYAE6OF02FI6FL.14.25.C03.1.454.CMB.1.raw
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
  modified_base (192)..(192): a, c, t, g, unknown or other
  misc_feature (192)..(192): n is a, c, g, or t
  modified_base (320)..(320): a, c, t, g, unknown or other
  misc_feature (320)..(320): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttggctgagctgggttttccncgttgctcttttaagnggtgtccagtgtcaggtncagctgggtgagtcgtgggggagcgtggtccagccgtgggacgtccctgacgtacctctcctgtgccacgcctcgtggtacttccaccttcacgttacctgtcgctagtcgcctacggtcgggtcccncgacggtcctacccggagggtcccggtaagggggccttagggggacggttgggggtacggaaccgtaagttttaactacgtacccaagtacgtacggtaaacgtacgggtaaaaccttaaggtaacggaaccggttactaacggtcccggaccccgttaaccgtcccggggtaaggaaccgggtccgtaaccgttacccgtaaccctaacgttaccctaacccgaacggtaaccgtaaaccgttaaaccttaacccgaaaacgaacctaaccggtacttaacggttaccgtacgtacgaacctaaaacgtaccgaaacgtacggtaccgtaaggaacgtacgtacgtacggaacgaccgacggtactacggttagttaacgttacggtacgggtaggacgtaggtaggtacgggacgttacgtattacggttaggtaggg

SEQ ID NO: 272528 - DNA, 596 bp, Homo sapiens
  misc_feature: GYAE6OF02HK0B1.14.25.C03.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (514)..(514): a, c, t, g, unknown or other
  misc_feature (514)..(514): n is a, c, g, or t
  modified_base (539)..(539): a, c, t, g, unknown or other
  misc_feature (539)..(539): n is a, c, g, or t
  modified_base (556)..(556): a, c, t, g, unknown or other
  misc_feature (556)..(556): n is a, c, g, or t
tcagcgtctagtaccacgaccggtgctcgatttagtagtgtagatttgggtttgggggggagacgagcccagcactggaagtcgccggtgtttccattcggtgatcagcactgaaacacagaggactcaccatggagtttgggctgagcggtgtttcgcgtaggcgtctttaagaggtntcagtgtcaggtncagctggtgngtcgnggggagcgtggccagcctgggacgttccagacgctctcgtgtgcagtcctgtaggacttcaccttcgaagtaccgtatcgacttatcggctacggtcgggaccgccgaggcccttacggaacgggcggtagggccttaggggaggtgggtggctaatttcaactctanagtgaagttacgaaactttanacggacnttaagcgtacgacgtccggtagacgggctacgtacacgtatccgacgagacgacttaagtaccgaaacgagacctacgagttcacggtacaacgttaagcgaaactccggntaggacagcgtagaacggctcgggnttacgtagttactaggnggtacgaagcgtaagcggtaatccgagttgtacggttagg

SEQ ID NO: 272529 - DNA, 667 bp, Homo sapiens
  misc_feature: GYAE6OF02I2B9H.14.25.C03.1.454.CMB.1.raw
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
  modified_base (602)..(602): a, c, t, g, unknown or other
  misc_feature (602)..(602): n is a, c, g, or t
  modified_base (656)..(656): a, c, t, g, unknown or other
  misc_feature (656)..(656): n is a, c, g, or t
tcagcgtctagtaccacgaccggtgctcgatttagtagtgtagatttggggtttggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagcgtggtggagtcgtggggagcgtggtccagcctgggacgtcctganctctcctgtgcagcctcgtggacttcgaccttcaacgtacctatcgactatgactcgtcgggtcccnccacggcctaccgaggtcggcggggtctgggtacggtgggacggctatagtctcgactagtagtagtacgggaaacttaacgtacggaacgtcgttaacgtcgtacccgaccggttacggtacgggaaaccgggtcctaacgttacccgaaccttaacgtcccgtacccgaaggtaaaccgtaaccgtaacgtttaaccgaaaacggtaaccgcaaaccgttagtactacgtgaaacttaaaggacgtaaaccgcgtaaccgtagaacggtgacgtaggaacgtacgacgttntaggtacttcgtaacgtggtacggaacgttggagtcgggagttacgaacggttnttgggtacggg

SEQ ID NO: 272530 - DNA, 655 bp, Homo sapiens
  misc_feature: GYAE6OF02F6SJH.14.25.C03.1.454.CMB.1.raw
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggagtccctgacgactctcctgtgcagcctctggattcaccttcacgtacctatgcttagtcgccaccgtcggggtacccgccgagggcctacccggaaggggccggagggggcgtggggacgggtgggggtggccggtaatttaactagtccaacgtataggagtagggaaacttaagtagacgacttagtcgacccgacgttccggagggaacgggtccgtacttcccgaacctacgttccctaccgaaaggaacgtaacctaaagttaacccgaaacgaaaccgaccgactagttaacttcgtacacgtaaatacgaaacgacgaccgtaggagtacgactaggaacggaccgacggtctagtacgttaagttacgtgggtacggagtaggagtgggacggtggtattagttagtacggg

SEQ ID NO: 272531 - DNA, 819 bp, Homo sapiens
  misc_feature: GYAE6OF02GSBV2.14.25.C03.1.454.CMB.1.raw
tcagcgtctagtaccacgaccggtgctcgatttagtagtgtagatttggggtttgggggggagacgagcccagcactggaagtcgccggtgtttccattcggtgatcagcactgaacacagaggactcaccatggagtttgggctgagctgggttttcctcgttgctcgttttaagaggtgtccagtgtcaggtgcagctggtggagtcgtggggggaggcggtaggtccaggccgtggggacggtcccctggagtacctcctcctggtgcagcctcgtggacttcctaccttacacgtacctagtgtacctagtcgcctaccggtcggggtacccgccgaacggcctaccgagggaccgggacgggggtcgttaggggacgggttggggtacgggacgtaatttagtacgtaccgaacgagttacggaagttaacggggtaaaccttaaagtacgggtacgtaccttaacggtcgaaccccggtacgtttcccgggaacgggtaaaccgggtcccgtaacgttacccgaacccgtaacttcccgtaaccgtaaacggtaaacgtaaccgtaaaactaacccggaaaaccgtaaaccgtaaccggaccgtaaacggttaacgttaccgtaacgtaaacgtaaacgttacgaaaccgacgtaaccggttaaggtaacgggtaccgtaacgtaaacggtaacggaaccggaccgggtacgttacgggttacggtttaaacgtttaccggttaggggtacggggtaaggtaagggtaacgggtgggtaacgggtaacgttaaggtttaggttaggttagggg

SEQ ID NO: 272532 - DNA, 739 bp, Homo sapiens
  misc_feature: GYAE6OF02GEUND.14.25.C03.1.454.CMB.1.raw
  modified_base (283)..(283): a, c, t, g, unknown or other
  misc_feature (283)..(283): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtgggacgtcctgagactctcctgtgcacgcctcgtaggtacttccaccgttnaacgttacctagtcgctatcgctacggtcgggtcccacgacggtcctaccgacgggccgggtacgggggccgtggggtacggtgggggtacggacgttaatttagtaactaccgaacgtagtacgtaacgtaacggtaaaacttaaggtaaccggtaacgtaccttagtacccggaccccgttaccggttccggtaacggggaacgggtacccgtactttacccgaaaccctacgttacccgtaccgaaaggtaacctaaaccgtaaacctacccgaaaacggaaccctaaacggacctaagttactacgtacgaactaaacgtcgaaacgtccgtacgtagaagtacggacgtaggaacggaccgtacgggcttagggtacgtttaagtaccggttagggacgggtagaagggttaggtccgggtaagttaccggtatttaggttagggttaggg

SEQ ID NO: 272533 - DNA, 658 bp, Homo sapiens
  misc_feature: GYAE6OF02FUCLJ.14.25.C03.1.454.CMB.1.raw
  modified_base (158)..(158): a, c, t, g, unknown or other
  misc_feature (158)..(158): n is a, c, g, or t
  modified_base (377)..(377): a, c, t, g, unknown or other
  misc_feature (377)..(377): n is a, c, g, or t
  modified_base (581)..(581): a, c, t, g, unknown or other
  misc_feature (581)..(581): n is a, c, g, or t
  modified_base (599)..(599): a, c, t, g, unknown or other
  misc_feature (599)..(599): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttggctgagctgggttttccngttgctcttttaagaggtgtccagtgtcaggtgcagctggtggagtcgtgggggagcgtggccagccgtggggacgtccctgagactctctgtgcagcctcgtggtacttccacctttcaacgtacctatcgctagtcgcacggttcggtcccgccgaggtccctaccggagggccggaagggggtcttaggggaggtgggtaggcgtaatttacgtanccgaactagtggtaatacgggtaaacctaaggtacgacgctagtcgacccgtaccggtttccggaagggaaccgggtccgtaacgttaccgaacccttactcccgtaccgaagaaccgtaaccgttaaaccttaccgaaacgtaaccgacgtactaagttactacgtacgaactaaagtacgaacgacgtaccgtaggacgtancgtaggaacgtacgcgtntgtacgtacgttaggtggtagggagagtaggtaggtagttcgtagttagtaggtacggg

SEQ ID NO: 272534 - DNA, 870 bp, Homo sapiens
  misc_feature: GYAE6OF02ID6PP.14.25.C03.1.454.CMB.1.raw
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
tcagcgtctagtaccacgaccggtgctcgatttagtagtgtagatttggtttggggggagacgagcccagcactggaagtcgccggtgtttccattcggtgatcagcactgaacacagaggactcaccatggagttgggctgagcgttgggtttcctcgttagctttacttttaagngggtcgtaccagttcgtacaggttnctacgcgttaggtcgggagtcggtagggggaggtccgtacggtacccagccgtcgggtaacgggtccctggaaacgtacctcccgttcctaggtacgaccgtcgtacccgtcgttaggtacttaccgtacccgtttaccaaccgttaaccctttaagttcgacttaacgtcggtacccgtaaccggttaccggggtacccgaccccgtagggtacccgttaccggaacgggacggggtaacggggccgttaggggtacgggttgggttacgacggttaaacttttacaacgttacccgaacgttacgtagtaagtttaagggaaaccttaaggtaaccggtacgtaattaccgtaaccgccgtaaccggtaccggtggaacccgggtacgtaacccgttactaacccgtaaccgtacccgtacaaacgtacggtaaacgtaaaccgttaacccggaaacgtaaacccggacggtaccgtaaccgttacctaagtaacccgtaaaactaaacgtacggttaaacgaccgggtaaccgagtaacgtaccgttaccgaacgtaaccggggtaacgtaccggttgtaacggtttaagttaccggtttaagtacggggaaggttaacggagtaggacggttaccggtaacgtaagttacgtaggtttaacggg

SEQ ID NO: 272535 - DNA, 798 bp, Homo sapiens
  misc_feature: GYAE6OF02IQ24Y.14.25.C03.1.454.CMB.1.raw
  modified_base (748)..(748): a, c, t, g, unknown or other
  misc_feature (748)..(748): n is a, c, g, or t
tcagcgtctagtaccacgaccggtgctcgatttagtagtgtagatttgggtttgggagacgagcccagcactggaagtcgccggtgtttccattcggtgatcagcactgaacacagaggactcaccatggagtttgggctggagctgggttttcctcgttgcttcttttaagaggtgtccagtgtcaggtgcagtctgggtggacgtcgtgggggaggcgttggtcccagccgtgggacggttccctggacgacttcctccgttgtcgcgacgtccttcgtggaactttccacccttcaacgttaccccttatggccttagtcggactaccgttcggggttccccgaccgtagggtccttaccgacggggcgggtacgggggtcttaggggtaggtgggggtggaccgtattttaacgacttcccgaacgtacgttggaaacgtttacggggaaactttaaaaccttaaggggtacccgtaaccgtttaagtcccggtaccccgggtaacccgtttcccggggtaaggggaaccggggtttacccggtaccgtttacccgaaacccttacggtaccctttcccgaaagtaacgggtaaccaaacgtttacccaaaacggtaaccgaaccgtaccggtaacgttacgttacctaggaccctaaaagttaccgaaaccgtacgtaccgtaaggtaccggacgtacggtacgggtaagaccgttacgggcttaggttacgttacttacggngggtttacggagtacggtagtgggtacggcgtaagttacgttagtacggg

SEQ ID NO: 272536 - DNA, 718 bp, Homo sapiens
  misc_feature: GYAE6OF02HWNBS.14.25.C03.1.454.CMB.1.raw
  modified_base (159)..(159): a, c, t, g, unknown or other
  misc_feature (159)..(159): n is a, c, g, or t
  modified_base (194)..(194): a, c, t, g, unknown or other
  misc_feature (194)..(194): n is a, c, g, or t
  modified_base (319)..(319): a, c, t, g, unknown or other
  misc_feature (319)..(319): n is a, c, g, or t
tcagcgtctagtaccacgaccggtgctcgatttagtagtgtagatttgggttgggggggagacgagcccagcactggaagtcgccggtgtttccattcggtgatcagcactgaacacagaggactcaccatggagtttgggctggagctgggttttccncgttgcttcttttaagaggtgtccagtgtcaggtncagctggtggagtcgtgggggagtcgtaggtccaggccgtggggacggtccctggacgacttctccgtggtacgccaggtccctgtggtacttccaccgtttcaagttacctaagtgtaaccttntgcctacggtcgggtaccccacgtaacggtccctaccggacgggtaccggacgggtcgtaggggtagggttcggggacggtaccgttaagtttatacgtacctacgtagttaggaaacgttacgggaaaacttaagtaccggacgtaccttaggtccgacccgtacgttaccgggtagggaaaccgggttccgtacttaccgtaccgtaacgttccacggtagaacgtaaccgtaacttaccgaaacgaacacggactaaggttactacgtacgaactaagtacgttaaacaccggtaccgtaggaacgacgtgtaacggacgtacgaggtcgtagtgttaagtacggtggacggtagaaggtaccgtgggacgttacgtagttacggttagttacggg

SEQ ID NO: 272537 - DNA, 762 bp, Homo sapiens
  misc_feature: GYAE6OF02G8FEH.14.25.C03.1.454.CMB.1.raw
  modified_base (180)..(180): a, c, t, g, unknown or other
  misc_feature (180)..(180): n is a, c, g, or t
  modified_base (412)..(412): a, c, t, g, unknown or other
  misc_feature (412)..(412): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcacatggagttgggctgagcttgggttttcctcgttgcttcttttaagaggttntccagtgtcgaggtgcagtcgtgggtcggagttcgtggggggagtcgtggtccaggcctggggacgtccctggacgtcctcgtcctggtcactacgcccttcgtggtaccttccaccgtttacgacgttaaccgtatcgtacctgtcacggtaccgttccgggggtccctacgaagggtccctaccgggtacggggaccggggtggggtccgtaggggtgggtttccggggngggtaaccttatttaaggtaactactaactaagtttggaatttacggaaaacttaacgtaggaccttactaacgtccgacccgggtactcggggtaacggaacgggtccgtacgtaccacctactctacgacgaacgtaacgtaacctaacgaaacgtaaccgaacgtacgtaacgtaacgtacgtaccggtaaataaccccccccgtaagtaaccgtacgaaccgtaacgtaacgtacggaccggttacggaacggaaccgtacggtacgtagttagttaacgttacgttagggtacggaggtacggtaggtacgggtaggttacggttacgttaggttaggttacggg

SEQ ID NO: 272538 - DNA, 667 bp, Homo sapiens
  misc_feature: GYAE6OF02JWCHN.14.25.C03.1.454.CMB.1.raw
  modified_base (160)..(160): a, c, t, g, unknown or other
  misc_feature (160)..(160): n is a, c, g, or t
  modified_base (182)..(182): a, c, t, g, unknown or other
  misc_feature (182)..(182): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (366)..(366): a, c, t, g, unknown or other
  misc_feature (366)..(366): n is a, c, g, or t
  modified_base (481)..(481): a, c, t, g, unknown or other
  misc_feature (481)..(481): n is a, c, g, or t
  modified_base (552)..(552): a, c, t, g, unknown or other
  misc_feature (552)..(552): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtgggttttccncgttgcttattttaaggaggtntccaggtgtcaggtgcagtctggtggacgtgtgggggacgcgtggtacnggcctgggacgtccngagtcttcgcctggtcacgtagcccttgtacggtactactacccttacggactacccttagtcggtcctttaacggcgaaccgttacgggtcccgggtttccccgacggacgggtacccncccgaaggggttacgggaccggggggtctaagggtacggggttcgggggtaccgtaacgagttttaactacaccgtaagtacgtacgtaggttaacgaacttaacgagacgttcncgtaagtcccgacttcggaaggaccggtccgtactcacctacgtcctacagacgtacgaatacaacgaacncgtactacattcacgtaacaatacgaacgactcgagtacgactccgagaacgcgtactcgtagtgtagttcgagtaagacgtaggtggtagtccggtatacgtagttaggtaggg

SEQ ID NO: 272539 - DNA, 624 bp, Homo sapiens
  misc_feature: GYAE6OF02I7UW8.14.25.C03.1.454.CMB.1.raw
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
  modified_base (300)..(300): a, c, t, g, unknown or other
  misc_feature (300)..(300): n is a, c, g, or t
  modified_base (541)..(541): a, c, t, g, unknown or other
  misc_feature (541)..(541): n is a, c, g, or t
  modified_base (552)..(552): a, c, t, g, unknown or other
  misc_feature (552)..(552): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (595)..(595): a, c, t, g, unknown or other
  misc_feature (595)..(595): n is a, c, g, or t
  modified_base (611)..(611): a, c, t, g, unknown or other
  misc_feature (611)..(611): n is a, c, g, or t
tcagcgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgaganctgaggacacggctggtnttattacnggtggganagatgggngtcgattgttgtagtggtggtagctgactaagtaacgtggagtccgacccgtcgggccacgggaccctggtccaccgtctcctcncgcctccaccgaaggtccccagtccggtcccgttccccgtcggccctaccctcccgtaccgtaacgacgtacctacctccggtacgggggcctaccgacgcccgggtcccgtacgggtccgtcggtccgtcgggtaaccgaacggtacctttaaccgttacccgtaacgtaacgtaccggtctacggacggtccgggtacgtcgggtaccgaaacgggccgtacgtaacgacggtacacgngaactcgacgngtacgacgacgtcgcgtcgacgacgtgcgcgngcgngtgtcgngtcgcgacgtcgtcgngtagcgcgagtcg

SEQ ID NO: 272540 - DNA, 740 bp, Homo sapiens
  misc_feature: GYAE6OF02G4PBV.14.25.C03.1.454.CMB.1.raw
tcagcgtctagtaccacgaccggtgctcgatttagtagtgtagatttgggtttggggggagacgagcccagcactggaagtcgccggtgtttccattcggtgatcagcactgaacacagaggactcaccatggagtttggctgagctgggttttcctcgttgcttcttttaagaggtgtccagtgtcaggtgcagctggtggagtcgtgggggagcgtggtccagccgtgggacgtcccgtgacgcctctccgtgtgcacgcctcgtggacttcaccttcacgttacctagtcgcttagtcgacctacggtcgggtacccgccacggccctccggacgggccgggaggggtcgtagggaggttcggggacggtaccgttagtttaagtaccgtaccgaacgtagttaggaacttaggaaaaccttaagtagaacccgagttaacgtccgaccccggttacgtcccggttaagggaaccggggttcccgtaattcccaacccgtaactccgtacccgaagaaacgtaaccttaacgttaaacccgaaacgaaccgaaccgtacgtacgtaattccgagaactaaagtacgaactacgaccgtaagaaggacgtccgtaggaaccggtaacggaccggttagttacggttacggtttaagtttacgggtaacgggtacgggtacggtaaggtacgggttaacggggacggttaacggtaagttttaggttagggttaagggg

SEQ ID NO: 272541 - DNA, 759 bp, Homo sapiens
  misc_feature: GYAE6OF02GSEEF.14.25.C03.1.454.CMB.1.raw
  modified_base (194)..(194): a, c, t, g, unknown or other
  misc_feature (194)..(194): n is a, c, g, or t
  modified_base (718)..(718): a, c, t, g, unknown or other
  misc_feature (718)..(718): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggagtttgggctgagcttgggttttcctcgttgcttcgttttaagaggtgtccagtgtacaggtncagctggtggagtcgtgggggaggcgtggtccaggccgtggggacggtccctgacgtcgtcctccgtgtcgcacgtcctcgtggacttccaccttcacgtacctatgctatgcacgtcggtccgcgacggtcctccgaggcggaggggtcgtagggagggtggggtggacgttaagttacgtacttacgacgttagtacggtagttaacggggtaaacttaaaggttacggaacccgtagttaacggtccgggtaccccgtaacccggtttcccggggtaacggggtaaaccgggggtaccccgttaacgtttaacccccggaacccttaacgtacccccggttacccgaaacgggtaaaccgtaaacccgtaaccgtttaaacccgaaaaccggtaaaccgaaccggtaccgtaagtaaccttcgtaacgtaactaagtaaccgaacgtaccgtacgtaggagttacgacgtacgggaagaccggacgtacgttgtagttaacgttggtacgggtaggtacgnggtaggtacggtaggtacggtaagttacggtaggttacggg

SEQ ID NO: 272542 - DNA, 830 bp, Homo sapiens
  misc_feature: GYAE6OF02I51T4.14.25.C03.1.454.CMB.1.raw
  modified_base (182)..(182): a, c, t, g, unknown or other
  misc_feature (182)..(182): n is a, c, g, or t
  modified_base (715)..(715): a, c, t, g, unknown or other
  misc_feature (715)..(715): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagtcgttgggttttcctcgttgccttagttttaaggnggttgtccagtgtcaggtgcagctggtggagtcgtgggggagtcgtcggtccagccgtggggacgtcctgacgactctctagtgcacgccttgtggtacttcctaccttcgaaccgttacctagtcgtcttagtcgaccgtacggttccgggggtcccaaccggacggtccttaccgggacgggtaccggggtacgggggccttagggggtacggggttggggtaacgggtacgttaaacgtttaacgtacgtaccgtaacgtagtacgggttaaacgtaaggggttaaactaaaggttaccggaaacggttccttaacggtaccggaaccccgggttaacccgttaccggggttaacggggtaaccggggttacccgttaaccttaaccccggtaaaccggtcccttacccgtaaccgggtaaaggaaaccggttaacctaaaaccggttaacccgaaaacgaaacccggtacgtaaccgtaagttacccgtcgaacgtaaacgtaaacgcaaacggttccgacgttacggnggtacgtccgaaggacggtaaccggtgtacgtaggtttacgttacgttacggagggaggtaaccggagtacgggtgggttaaccgttaggtttaacgttcgggttaggttacggg

SEQ ID NO: 272543 - DNA, 649 bp, Homo sapiens
  misc_feature: GYAE6OF02GE6B4.14.25.C03.1.454.CMB.1.raw
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
  modified_base (582)..(582): a, c, t, g, unknown or other
  misc_feature (582)..(582): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttggggctgagctgggttttcctcgttgcttcttttaagaggtgtccagtgtcaggtgcagctggtggagtcgtggggggaggcgtgggtccaggcctggggaggtccctgagactctcctgtgcagcctctggacttcgaccttcagtacctatgctatgcacgtgggtcccgccaggcctcgacggcggaggggctgggagtgggnggcgtattactatcanatcgatacggaactaataggacnctagtcgaccgacgttcggtaggaacgggtcctattaccacctatccgtacgagaacgaactaactaaccgaaacgtaacgacgacgtaaggttactacgtagaacgtaaagttacggaaaccgtcggaccgtaggtaacgacggtacgtaacgggaacggtaaccgaccgggtccttagggtacgttacgttaaggnggggttacgggaaggttaggtaagggtacggggtaggtacggtaggttacggttaggttaacggggg

SEQ ID NO: 272544 - DNA, 734 bp, Homo sapiens
  misc_feature: GYAE6OF02IYNUY.14.25.C03.1.454.CMB.1.raw
  modified_base (182)..(182): a, c, t, g, unknown or other
  misc_feature (182)..(182): n is a, c, g, or t
  modified_base (354)..(354): a, c, t, g, unknown or other
  misc_feature (354)..(354): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
tcagcgtctagtaccacgaccggtgctcgatttagtagtgtagatttgggtttggggggagacgagcccagcactggaagtcgccggtgtttccattcggtgatcagcactgaacacagagactcaccatggagtttgggctgagctggttttcctcgtgcttctttaagaggtgtccagtntcgaggtgctagcttgggtcggagttcgtagggggacgcgtggtcccaggcccgtggggacgtccctggacgacctcgtcctaggtcgcgagtcccgtacgtggtaacttcctaaccgttcgaggttaaccctagtcgacttagtcggtaccctacggtccggggttacccncggttaaggtcctcccgtaaagggggcccggttaaggggccttaagggtccgggtgggttaacggactaagttctaagcctaaacgtgtgacggtacgaaaacttanacggtnacctaagtccaccggtacctcgggtaaacggacggtcccgtacgtaccgtactactactaccgtaacgacgtaacgtaacgtaacgtaaacgaacgtacgtaacgtacgtaacgtaccgttacgaaccgtaacgtaacgtacgacggtactacgggtacgtacgtaccggtacggaaccgtaacgtaccggtacgtacgttacgttaagtacccgttgggtaaggtacgaggtaggttacggaggtacgtaagttacgttgtacggg

SEQ ID NO: 272545 - DNA, 622 bp, Homo sapiens
  misc_feature: GYAE6OF02J1YIF.14.25.C03.1.454.CMB.1.raw
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (320)..(320): a, c, t, g, unknown or other
  misc_feature (320)..(320): n is a, c, g, or t
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (517)..(517): a, c, t, g, unknown or other
  misc_feature (517)..(517): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (563)..(563): a, c, t, g, unknown or other
  misc_feature (563)..(563): n is a, c, g, or t
  modified_base (590)..(590): a, c, t, g, unknown or other
  misc_feature (590)..(590): n is a, c, g, or t
  modified_base (609)..(609): a, c, t, g, unknown or other
  misc_feature (609)..(609): n is a, c, g, or t
tcagcgtctagtaccacgaccggtgctcgatttagtagtgtagatttgggtttgggggagacgagcccagcactggaagtcgccggtgtttccattcggtgatcagcacgtgaaccacagacggactcaccatggacgttttggcctggacgcttgggttttcctcgttgctctttttaagaggtgtacctagtgtccaggtgcagcttggcgagtcngggggcncgtcgtcacgcgtgggcgtcctgaacgctctaccgtgtacncgacgcgtcttgaacctttcgacctttcgaacgttacctgcgcttacgtcgacncggttcgtaccgtccgagacctcgngggttccgaggggacctggggtacggtgaccgtnttaaacgcactacgaangtaaggttcgaaactttagaaancccggttctaaggcccgtaagtccccgtcggtaaagccggttacgacgtaccgctacgtcactacgagactaacgtactaacgaacgcgtacaagtanactacggcaactagaaccacgtcaggccaatccgntacgngaccgngtccgtgtaccttaagtcgagtaacgngtacggcgagtaccgggtntacggtgttacgg

SEQ ID NO: 272546 - DNA, 765 bp, Homo sapiens
  misc_feature: GYAE6OF02IC2WN.14.25.C03.1.454.CMB.1.raw
  modified_base (322)..(322): a, c, t, g, unknown or other
  misc_feature (322)..(322): n is a, c, g, or t
tcagcgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcttgggttttcctcgttgcttctttttaagaggtgtccagtgtcaggtgccagctggtggagttcgtgggggagtcgtggtccagcctggggacggtccctgagtactctcctgtgctagccctgtggatttccaccttcagtaccctatcgactaatgcctaagtcggggtccncccgaggcctccgaagggccggtaggggctgggaaggtcgggaggaccgtaattactagcacaagttgaactagggaaacttaaagtacggacgtactaacgttcgaacccggtacgttcccggtaagggaaccggggtacccttaagttcccaaacccgtaacttacccgtacccgaaaggtaaccggaaacttaaaccgtttacccgaaaaagtaaaccccgaacgtaaccgtaaagggtttaactacccgttaaggaaaccctaaaaagtacgtaaaaccgaccgtccgtaaggaagtacgtacccgttaagggaaaccggggtaaccctaccgggttagtttaaccgggttaggttaacctttaaaggtcgggttaaggggaaccgttagtaacgggttaggggtaaccgttaggtaaagttcggtttaaggtaagggg

SEQ ID NO: 272547 - DNA, 900 bp, Homo sapiens
  misc_feature: GYAE6OF02JLMWB.14.25.C03.1.454.CMB.1.raw
  modified_base (820)..(820): a, c, t, g, unknown or other
  misc_feature (820)..(820): n is a, c, g, or t
tcagcgtctagtaccacgaccggtgctcgatttagtagtgtagatttggggtttgggggggagacgagcccagcactggaagtcgccgggtgtttccattcggtgatcagcactgaacacagaggacctcaccatggagtttgggctgagctgggttttccctcgttgcttcgttttaaagagggtcgtccaggttggtactagggtcgcaggccgttgggtagggtaacggttccggtaggggggagggtccgtacgggtcccaggtccccgtgggggacggttccccgtggtaacgtccgttccgttccgtggttaggccccgaagtcccgttacgtcggggtacctttacccacccgtttccgaaaccggtttaccttactccggttaccgacgttcggtaccgttaacccggttcgggggtccccccgaccgggaccggtacccccttaccgggaccgggggttacccggggaaggggtccgggttagggggtacggtcggggggtacgggtccgttaaacgtttaactaccgtaaccgaacgttaggtcgtaaaggtacgtaaaacgttaacgtacggttaccacggttacgtcccggtacccgtaaccggtccgggtaaccgggtaaaccggggtcctaaccgtttaccctaaccggtacgttcccgaaccggttacgaaacgaaccccgttaacttaaaccccgaaggtaaacccgacgtaaccggtaagttacgtaccgtaaccggaaccgtaaagttccggaacctaaccggtacccaaggttacgacgatacgggaactaagaccgggtntagtaccggtttaacgttacggtgggtaaccggttaaggacgggtagtacgggtacgtacggtagtggttaggtacgggg

SEQ ID NO: 272548 - DNA, 826 bp, Homo sapiens
  misc_feature: GYAE6OF02GDFR4.14.25.C03.1.454.CMB.1.raw
  modified_base (115)..(115): a, c, t, g, unknown or other
  misc_feature (115)..(115): n is a, c, g, or t
tcagcgtctagtaccacgaccggtgctcgatttagtagtgtagatttgggtttggggagacgagcccagcactggaagtcgccggtgtttccattcggtgatcagcactgaacanagaggactcaccatggagtttgggctgagctgggttttcctcgttgctcttttaagaggtgtccagtgtacaggtgcagctggtaggagttcgtgggggagcgtggtccaggcctgggacgtccctgagtactctctgtgcacgcctcgtgtattccaccttgacgtacctatcgcttagtcgctacggttcgggtcccgaccgacgggtcctaccggacggggtacgggcgggggtccgttaggggacgggttcgggggttcggtaccgttaagtttaacgttaacggtaccaaccggtaagttacggtaagggttaccggtaaaaacgttaacgtaccggtaacgttacttaacgggtcgtacccgggttacccggttacgggtacgggaaaccggggttcccgtaacgtttaccctaccgtaaccgttacccgtaacccgtaacggtaaccgtaaaccgttaaaccgttaacccgtaaaacggtaacccgtaaacggtacccgttaacgtaaccgttaccgtacggtaaacctaaacgttaccgaaaccggtacccgtaccgacggtaacgtaccggtacggtacggaacgtaccgtacggttaccggttagttaccggtttaaggtaccggttaggggtaacgggtacggttaaggacggttacgggttacggttacccgtaaggtttacggtttaaggttacgggg

SEQ ID NO: 272549 - DNA, 725 bp, Homo sapiens
  misc_feature: GYAE6OF02JQHZI.14.25.C03.1.454.CMB.1.raw
  modified_base (156)..(156): a, c, t, g, unknown or other
  misc_feature (156)..(156): n is a, c, g, or t
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (421)..(421): a, c, t, g, unknown or other
  misc_feature (421)..(421): n is a, c, g, or t
  modified_base (577)..(577): a, c, t, g, unknown or other
  misc_feature (577)..(577): n is a, c, g, or t
  modified_base (644)..(644): a, c, t, g, unknown or other
  misc_feature (644)..(644): n is a, c, g, or t
tcagcgtctagtaccacgaccggtgctcgatttagtagtgtagatttgggtttggggagacgagcccagcactggaagtcgccggtgtttccattcggtgatcagcactgaacacagaggactcaccatggacgtttgggctgagctgggtttccngtagctactttaagnggtntccagtgtcaggtgcagctggtagtagtcgtagggggacgtcggtacgtccaggccgtaggggacgtccctaggaacgtcgtcctacgtgtgaccacgccttgtaggtacttaccgtaaccttcgtaacgtacccttgtaccgtctaatcgctacgtccgggtaccncgagtcctaaccggnggaccggtgggacgtggtacggtggcggtagtattaacgtctagctagtcggtataacggtaanaacgtaggacctacgtatccggtaacctaccgtttacgggaaccgggtaacgtacccgttacgtacggtaaccctagttaaccccttacgggaacggtaacctaacgtaaccgttaaaccggaacgtaacggacctacggaacttaacgtacggtntaaaaccttaggaacgtaaacgtccgacgaaccgtacgaggtaaccgcggaaacggtcctaccggtntaacgttccgggaattacgggtcgtaggtaacgttagggacggtaacggtacggtaatacggttcgtaaggtttaacgggg

SEQ ID NO: 272550 - DNA, 809 bp, Homo sapiens
  misc_feature: GYAE6OF02FQQ7R.14.25.C03.1.454.CMB.1.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
  modified_base (427)..(427): a, c, t, g, unknown or other
  misc_feature (427)..(427): n is a, c, g, or t
tcagcgtctagtaccacgaccggtgctcgatttagtagtgtagatttgggtttggggggggagacgagcccagcactggaagtcgccggtgtttccattcggtgatcagcactgaacacagaggactcaccatggagtttgggcctgagctgggttttcctcgttgcttactttttaagaggtgtccagtgtcaggtncagctggtgagtcgtggggacgcgtcggtcacggccgtgggacgtcccgtgagtacctcctccgtagtnaccgtaggcctccggtggtacttccaaccctttnaccggttaacctatcgtacgttacgtgtaccacgggttaccggccccggacgacgggtcctaccggagggtccggaacggggtcggttcgggtaggggtcggggtagggcgttaagttacgttaanacctacagtaggtacgtaggtaaaccttaaagtacgtacgtacgtagtccggacccggtacgtaccggttaaggaccgggtaccttacgtacctaaccgtacctccgtaacgtacgaacgtaaccgttaaccttaaccgaaagttaaacccgaacgtaccgttaaacggttaccctacgtacggtaaaccgaaacgttaaacggaacgttaaccgtacgggttaaacggtaagcgtttaaccgtacgggaacggtaacccgggccgggtttatttcggggttaagtttaaaccggttcgggtttaaccggagggttaacggaaggtacgggttaacggggtaggtttaaccgggtaagttttacggtttaagggtacggggg

SEQ ID NO: 272551 - DNA, 536 bp, Homo sapiens
  misc_feature: GYAE6OF01AKS7J.21.76.G10.1.454.CMB.1.raw
  modified_base (295)..(295): a, c, t, g, unknown or other
  misc_feature (295)..(295): n is a, c, g, or t
  modified_base (499)..(499): a, c, t, g, unknown or other
  misc_feature (499)..(499): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccnccaggctccgagggaagggctgggagtgggtctcagtttatttatagtggtggtggtgcagattacgcagactccgtgaagggccgattccaccatctccagagacaacttccatagaacacgctgtatcttacaatgaacacgcctgagagccgacgacacggccgtctattactgtcgcggacgggagtggacggggagggngggcgagtggattacgtttagacctaggtgggggacg

SEQ ID NO: 272552 - DNA, 800 bp, Homo sapiens
  misc_feature: GYAE6OF01DY41E.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggttcaccgtcactactaactccatgagctgggtccgccaggctccgaggggaagggcgtgggagtgggtctcgtagtttatttagtaggtggtggtggtgcgagtattacggcagtacgtccggtaggaaacggggcccgtaatttccgaaacccgtacttaccgtacccgaaggtaacgaacctaaactttcccaaagttacgaaacccgtaccggtaccttacggtttaacttaccttttaacaaaagtttacggaaacctacggtaccccgttaagggaacggaaccggtaccccggaaaccggtaacccgtaaccccggggttaccccgtttaccgtttaaaccgtttaccggttaccgggttacgggtaccccgggtaaacggggggtacgggttaaccggggtaaaccgggggggaacggggtaacgggggggacccttaaaggggttaccggggttaaaacggttttaacccggttttaaccggggaaacccccgggttaacggggttacccggggggggggtaaacccccggg

SEQ ID NO: 272553 - DNA, 534 bp, Homo sapiens
  misc_feature: GYAE6OF01BL8VV.21.76.G10.1.454.CMB.1.raw
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactaactccatgagctgggtccgccaggctccgaggggaggggctgggagtgggtctcgagttatttagtagtggtggtggtgcagattacgcagactcgtgaagggcattcacatctcagagacattcatgaacacgctgtactcttacaaatcgaacagcctagagacgccgacgacacggcctactacttacgtgtcgcgacgggngtcggacgggaggnggcagtggtacttacgttagaccgtggtgggggaaccg

SEQ ID NO: 272554 - DNA, 575 bp, Homo sapiens
  misc_feature: GYAE6OF01BEV9O.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactaactccatgagctgggtccgccaggctccgaggggaggggctgggagtggtctctagttatttagtagtggtggtggtgcagattacgcagactccggtgaagggccgattcaccatctccagagacaattccatagaacacgctgtatcttacaaatgaacacgacctgagagcccgaacgaccgaccggccgttactacttacgtggtcggaccgggaacggggacggtcgggaacgggggagggacgggaccgagtacgggtattacgtttacggaccgtacgggtcgggggaccg

SEQ ID NO: 272555 - DNA, 585 bp, Homo sapiens
  misc_feature: GYAE6OF01DPGR4.21.76.G10.1.454.CMB.1.raw
  modified_base (154)..(154): a, c, t, g, unknown or other
  misc_feature (154)..(154): n is a, c, g, or t
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
tcagtcgtcgctcgcacgaccggtgctcgatttagtcactcatacgaggggctgggagaggagcccagcactgggattccgaggtgtttccattcggtgatcagcactgaacacagaggactcaccatggagttttggctgagcggtgttcgtntaagtntcaaagtgcagtgtgngtgcagtctgngagactggagagntgatccgacgtggggcctgagcnctacngtcgcggtctgtcggtacacgtnacgtactaatccagcgngtccgtggccgccaaggcttacgagggaggcttgggngtcgtctgtaagttntagtggtggtggtgngaagtagtagtacgtacgacgtacgtcggtacggtacggacgtactaccgtactactacgtacgacgactaacgtactactactacgtacgacgtacgtacgtactactaactaatacgaacgacgacgagagacgaccgaccgaccgaccgtaccgtacgtacgtacgtggtcgacggtacggtacggtacggagggacggacggagtagtacgtacgttacgtacggacggtacggtacgggtaccgg

SEQ ID NO: 272556 - DNA, 670 bp, Homo sapiens
  misc_feature: GYAE6OF01DL72K.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtgggaggagacttgatccgaacgtgggggtccctgagactctcctgtcgcgtctcgtggtcaccgtcactactaactccatgagcgtgggtccgccgacggcctccggaggggaacggggtcgtcgggtaggtgggtctcgtagtttaatttagtaggtgggtggtggtgcgaagtattacgcagaccgtcggtaggaacggccgtaattccactactcctaccgagaacgtacctaatttcccgaattacgaaaccgtcgtacttagtaacttcttaaccaaaagttcggaaacctaggtaccgtacggaacgaaccggaccccgtaacggaacccgtacccggtaccgttacttaagttacccgtgtacgggaccggaacgggtaggtacgggaaggggtaggacgggtacaagggttacgggaactttcggtttaaggacccgtaagggtgggggtaaccccg

SEQ ID NO: 272557 - DNA, 731 bp, Homo sapiens
  misc_feature: GYAE6OF01AQXYI.21.76.G10.1.454.CMB.1.raw
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtggttttcctgttactatttcaaaaggtgtccagtgtgaggtgcagctggtggagactggaggagacttgatccaacctggggggtccctgagactctcctgtgcggtctctgggttcaccgtcactactaacnccatgagctgggtccnccaggctccgaggggagggctgggagtgggtctcgtagttatttagtagtggtggtggtgcgtagtattacgcgagaccgtcggtaggaacgggtcccgaagtttccaacccgtatccttcccgaaggtacgaacctaaactttcccgaaattcggaaacctaccggtaccttacgttaacttcctttaaccaaaagttacggtaaacctacggtaccccttaggaaacggaaccggacccggaaacccggtaaccggaaccggggtccccgtttaccttaacgtttaaccgtagggtttcgggaccgggtaaccggggggtaggttacgggggaacccggggggaacggggtaacggggtccgtaagggttacgggtaaacgtttaaccggttttacggaaccccggttacgggttacggggggggtaaaccccgg

SEQ ID NO: 272558 - DNA, 701 bp, Homo sapiens
  misc_feature: GYAE6OF01AXOFU.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctcgtggtcaccgtcactactaactccatgagtctgggtccgccgaggcctccggaggggaacgggcgtgggaggtgggtctacgtagtttatttagtaggttgggttggtgggtgacgagtagttacgacgtaacggaccgtccggtaggaacggggtccgtaagttaccaaccctattacccgtaccgaaggaacgtaacctaaacgtttcccaacgttagaaaccgtccgtaccttgttaacttacctttaacaaaagttcgaacgtaacgtcccgtaggaacgaaccggcccggaacggaacccgtaccgggtccttacgttacttaccggtgggtcggaccgggaacggggtaaggtcggggaaccgggggtaggggacgggtaccaaggttcgggtaaactttaccggttacggaacccgggtagggcgggggtaacccggg

SEQ ID NO: 272559 - DNA, 754 bp, Homo sapiens
  misc_feature: GYAE6OF01CDALW.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtgggaggagtacttgatccgaaccgtgggggtccctgagactctctgtgcgtctcgtggtcaccgtcactactactcatgagcgtcggtccgcgaggcctccggaggggacgggctgggtaggtgggtctcgtagtttatttagtaggtgggtggtggtgacgtaagtagttaccgcgagtacccgtacggtaggaacgggtccgtacttaccgaacctactccgtacccgaagtaacgaacctaaacttcccgaagtaccggaaacctaccggtactttacggttaactttaccgttaaacgaaaacgtttacgaaaccgtacggtacccgttaaggaaaccggtaaccgggtaacccccggaaaccgggacccggtaaccgggttaccccgttacgtttaaaccgtttaccggttacgggttaccgggacccggggtaaacgggggtacgggtacggggaacgggggaggggtaaccgggaccgtagggttacggtaacgtttaccggtttaccggaaaccggtacgggggttccgggggaaacccggg

SEQ ID NO: 272560 - DNA, 743 bp, Homo sapiens
  misc_feature: GYAE6OF01A7T05.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagactggaggagacttgactccgaaccgtgggggtccctgagactctctgtgcggtctcgtggttcaccgtcactactaactccatgagcgtcgggtccgccgaggcctaccggaggggaacggggtcgtagggacggtgggtctcgtagtttatttagtaggtgggtggtggtgacgtaaggtacttacggacgacgtaccgttccggtaggaaacggggtcccgtaagtttacccaaccgtacgttaccgtacccgaaaggtaaccgtaactaaactttcccgaaagttacgaaaccctacggtacctttaggttaacctaccgttaacaaaagtcgaaacgtacgtacccgtaggaaccgaacggaccccggaacgtaacccgtaccgggtccctttaacctagttacccggttggtacgggtaccgggtaaacgggggtaacgtcgggggaaacccggggagggacggggtcctaaagggttcgggtaaaaccgtttccgttaaccgggaacccggtagggttaccgggggggaaacccg

SEQ ID NO: 272561 - DNA, 791 bp, Homo sapiens
  misc_feature: GYAE6OF01EA8ZE.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcgttgggttttccttgttactatttacaaaaggtgtccagtgtgaggtgcagctgggtggagacgtggaggagtacttgactcccgaaccggtcggggggtccctagacgtacctcctccgtgtgcggtctcgttgggttccaccgtcactactaacctccatgagcgtcgggtccccgccgacggccgtaccggaagggggaacggggcgtgggtaggtcgggtcttcgtaagtttagtttagtaggttgggtgggtggtgacgtagtattacggctagtaccgtccggtaggaacgggtccgtacttaccaacctactcctaccgaagaacgtaactaacttacccaagtacgaaaccgtaccgtacttacgttaacttaccttaaacgaaagttaccgaaacgtaccgtaccgtaaggaaccgggtaaccgacccggaaaccggtaacccgtacccgggtaacccttaacctttaacggttaccgttacgggtacccggggaccgggtaaacggggtaacgggtacgggggaacggggggtaacgggtaacggggacgttaaggggttaacggttaaccggttttaaccgttaacccgggggtaaaccggttaccgggggtccggggggggtaaaacccccggg

SEQ ID NO: 272562 - DNA, 842 bp, Homo sapiens
  misc_feature: GYAE6OF01D3966.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagactggaggagacttgatccgaaccgtgggggtccctgagactctctgtgcggtctcgtgggttcaccgtcactactaactcatgacgcgtgggtcccgacgaggcctccggaagggggaacggggtctagggacggttgggtcttacgtaagtttatttagtaggtgggtggtagggtcgacctaagggtactttaccggcgtaacggtaccgtccgggtaaggaaaccgggggtccctaagtttccccaaacccgtaacttcccgtaaccccgaaaggtaaaccggtaaaccttaaaccgttttaccccgaaagttacgggaaaaaccctaccgggtacccgttttaagttaaccgtttaccctttaaacgaaaagtttacccggaaaaccgttaccggacccgttaagggaaaccggtaaccgggaaccccgtaacgggaacccgtacccggggttcccttaacgtttaacgtttaccggtacgggttaccggacccggggtaaacggggggtaacgttacggggggaaacccgggggtaagggggtaaccggggtactaaaggggttacgggtaacgttttaaacccggttttagggaaacccccgggtttgggggtaccggggggggtaaaccccgg

SEQ ID NO: 272563 - DNA, 754 bp, Homo sapiens
  misc_feature: GYAE6OF01CJG1J.21.76.G10.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtggtggagacgtgggaggagacttgactccgaaccgtcgggggtccctgagactctccgtgtgcggtctcgtggttccacgtcactactaactccatgagcgtcggtccnccgaggctaccggaggggaacggggcgtagggaggtcgggtctacgtagtttatttagtaggttgggtggtggtgacagtacgttacgcgaacgtacgtccggtaggaacgggtaccgtacttaccacctacttccgtaccgaagaacgtaacctaacttcccaagtacggaaacctcggtactttagtaactttcctaaacgaaagttccgaaaccgtcggtacccttaggaaccggtaaccgggacccccggaaacggtaaccccgtaccggggttacccctttaagttaaccgtttacggttcggggaccgggtaccggggaacgggggttagggtaccgggggaacggggggtaaagggtcggggtaaccttagggttaacgggtaaaccgtttttaccgttaaccccggggaacccggtccggggggttcggggggtaaacccccg

SEQ ID NO: 272564 - DNA, 561 bp, Homo sapiens
  misc_feature: GYAE6OF01B4W13.21.76.G10.1.454.CMB.1.raw
  modified_base (299)..(299): a, c, t, g, unknown or other
  misc_feature (299)..(299): n is a, c, g, or t
  modified_base (413)..(413): a, c, t, g, unknown or other
  misc_feature (413)..(413): n is a, c, g, or t
  modified_base (455)..(455): a, c, t, g, unknown or other
  misc_feature (455)..(455): n is a, c, g, or t
  modified_base (489)..(489): a, c, t, g, unknown or other
  misc_feature (489)..(489): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctcgtgggttcaccgtcactactaactccatgagcgtgggtcccnccaggctccgaggggaaggggctgggagtgggtctcgtagtttatttagtaggtgggtggtggtgcgagattacgcagactccggtggaacgggccattcaccatcctacaganactaattccatacgaacacgctagtactctacaaatcgaacngcctgacgacgccgacacgcggcctatacttacngtcgcggacgggagtcgggacgggagggacgggctaggtggtacttacgttggaaccctgggtgggggaccg

SEQ ID NO: 272565 - DNA, 616 bp, Homo sapiens
  misc_feature: GYAE6OF01C9NMA.21.76.G10.1.454.CMB.1.raw
  modified_base (564)..(564): a, c, t, g, unknown or other
  misc_feature (564)..(564): n is a, c, g, or t
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagctgggttttccttgttactatttacaaaaggtgtccagtgtgaggtgcagctggtggagacgtggaggagtacttgatccaaccgtggggggtccctgagtactctcctgtgcggtctcgtggtcatcgtcactactaacctcatggagcgtgggtcccgccgaggcctacggagggagggctgggagtggtctgagtttattagtaggtggtggtggtgacagtattacgacacgactcgtaggaacgggtcccgtaattaccactactaccgtccaagtacgaactaacttacaagtacgaaacgacgtactagttacttacttaacaaactacgtaacacgtactagaacgtacggacccgaacgaccgacggtccctagtacttagtggtacgcgggaacgggagtagggaacgggngggacggactaaggtggtaacttagttaccgtaccggacgggtaccgggggg

SEQ ID NO: 272566 - DNA, 637 bp, Homo sapiens
  misc_feature: GYAE6OF01BGDCN.21.76.G10.1.454.CMB.1.raw
  modified_base (458)..(458): a, c, t, g, unknown or other
  misc_feature (458)..(458): n is a, c, g, or t
  modified_base (548)..(548): a, c, t, g, unknown or other
  misc_feature (548)..(548): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagcgtgggtggagacgtgggaggagtacttgactcccgaaccgtcggggggtccctggacgacctctccgtgtcgcggtctcgtcggtcaccgtcactactactccatgagcgtcggccgccgaggccgtccggaggggacgggtcgtggtaggtcgggtctacgtagtttatttagtaggtgggttggtggtgacagtacgtacgctacgtacgtcggaggacggctactcactactccacaggacaacttaactccaatacgaaccncgtgttagtactactactaaagtcaaacgtacgtaccgtaggaacgaccggtacccgacggtaccgaccgggttacctattaacgttcgnggtacggacgggtagggtacggtgggacggggaggcggtacaggttacggtacttaccggttaggaccgtacgggggtggggaaccccg

SEQ ID NO: 272567 - DNA, 788 bp, Homo sapiens
  misc_feature: GYAE6OF01D6ZMB.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagcgttgggttttccttgttactatttacaaaaggtgtccagtgtgaggtgcagcgtggtggagacgtggaggagtacttgactccgaaccggtgggggtccctgagtacctctcgtgtcgcggttctcgtcggtccaccgtctactactactccatgacgtcgtcgggtcccgcgaggcctaccggagggggaacgggcgtagggtaggttcgggtactacgtaagttttatttaggtagggttgggttagggtggtagtcgtaaggtaacttaccggctaacggtaccgttccggtagggaaaccggggtcctaagttacccaaccgtacttcccgtaccgaagaacgtaaccttaacgttccgtaaagtacgaaaccgtcgttacgttacgtttaacttcccttaaacgaaacgttacggaaaccgtcgtacccgtaaggaaccggtacccggaccgggaaacccgtaaccggtaccccgggttacccgttacttaacggtttacccgtagggtaccggaaccgggggtaacgggtaagggttcggggggaaaccgggggaggggtacccggacgttaagggtaaccggttaactttaaccggttaccggggaacccggtacggggtcgggggggtaaaccccg

SEQ ID NO: 272568 - DNA, 759 bp, Homo sapiens
  misc_feature: GYAE6OF01DMDXR.21.76.G10.1.454.CMB.1.raw
  modified_base (652)..(652): a, c, t, g, unknown or other
  misc_feature (652)..(652): n is a, c, g, or t
  modified_base (701)..(701): a, c, t, g, unknown or other
  misc_feature (701)..(701): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagcttgggttttccttgttactattcaaaaggtgtccagtgtgaggtgcagcgtggtggagacgtgggaggagactcgactccgaaccggtcgggggtccctaggacgtacctcctccgtggtcggtccgttcgtcgttcggttccaccgtcactaactaactccatgacgtcggtcgggtcccgaccgaggtcctccgggaagggaaggggtcgtgggtaggttcgggtttactagtttagttagtaggtgggtcgggtggtacgacgtagtactacgactacggtaccgtaccggtaggaacgggtctaacttaccgaaccctacttccgtaacccgaggtaaccgtaacttaaccgttacctaaggttaacccgaaaccgtccggtacgtttaaggtaccttaacctttaacaaaagtaccgtaaaaccgtcggtaacccgtaggaaccggaaccgtacccgggaacccgtaaccggacccggttaaccttaaccgtttagtacccgngggttaccgacggggtaacgggtaggtacgggacgggggagtaccgggntaaggtacgtaacttaccgtacggaacccgtcgggggtaacgggccgttaaacccggg

SEQ ID NO: 272569 - DNA, 673 bp, Homo sapiens
  misc_feature: GYAE6OF01E4QUR.21.76.G10.1.454.CMB.1.raw
  modified_base (299)..(299): a, c, t, g, unknown or other
  misc_feature (299)..(299): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagctggtggagacgtgggaggagacttgatccaaccgtggggggtccctgagactctcctgtgcggtctctggtcaccgtcactactaactccatgagcgtggtcccnccgaggcctccgaggggagggcgtggaggtggtctcgtagtttatttagtaggtggtggtggtgacgtagagttacgcgaagtaccgtccggtaggaacgggtcctaagttcccaacctacttccgtaccaggaaacgtacctaaagtttcccaaagttacggaaactacgtacttagttaacttactttaacaaaagtcgaaaccacggtcccgtagacgggaaccgcccgtaagtacggaacccgacgggtaccccttattaacgtttaccgtgggttacggacccgggaaggggtacgttacggggaaacggggtgggacgggtacaaggttgggaactttacggtttcggaacccgtggggtaccggggg

SEQ ID NO: 272570 - DNA, 797 bp, Homo sapiens
  misc_feature: GYAE6OF01CF166.21.76.G10.1.454.CMB.1.raw
  modified_base (306)..(306): a, c, t, g, unknown or other
  misc_feature (306)..(306): n is a, c, g, or t
tcagtcgtcgctcgcacgaccggtgctcgattttagtcactcatacgtagggggctgggagaggagcccagccactggggattccgaggtgtttcccattcggtgatctagcactgaacacagaggactcacccatggagttttggctgagtcttgggttttccttgttactatttcaaaaggtgtccagtgtgtaggtgcaggactggtggacgtacgtggaggagacgttgactccgaaccgtgggggtccctggacgacctctcctgtcgcggtctcgtggtaccaccgtcactactacctcntcgagtcgtcggtccgcgaggctccgagggacgggacgtcgggagtgggtacctagtacgtttatttacgtaggttggtagggttggtacgcgtaggtacttacggactacggtaccgttccggtaggtaccgggtaccctaactttaccgaccctagttcccgtaacccaaggtaacggtaaccctaaactttaccccgaagtttaaccggaaacctaccgggtttaaccttagtttaaccgtttaccgttaaaccgaaagttaccggtaaaccgtacggtaccccgttagggtaaccggaaccgggaccccgggaaaccgtaccggtacccgggtttccccggttaacgttaacggttacccgtaggggtacggtaccggggaacgggtagggaacggggtacggggaacggggttcgggactaagggtaccgggttaactttacccggttacggtaaccccggttggggtaccgggggtaaaccccgg

SEQ ID NO: 272571 - DNA, 738 bp, Homo sapiens
  misc_feature: GYAE6OF01BODLA.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctggtggagcgtggaggagacttgactaccgaaccgtcggggggtccctggacgtacctctccgtgtcgcggtctcgtggttcaccgtcactactacctccatgagcgtggtccgccgaggctccgagggagggcgtggagtgggtctcgtatttagtttagtaggtggtggttggtgctagtattacgcgtacgtacgtccggtagaacgggccgtacttaccgacctacttaccctaccgaagtacgaaccttaacttacccaattacgaaccgtacgtaccgttcgttaacttacctttaacgaaaacgtacgtaaaccgtacctacccggtaaggaccggtaaccggaccccggtaaacccggtaacccggtaacccgggtcccgtttaacgttaaccggttttaaccgttcgggtaccggtaccggggtaacggggtacggttaccggggaaccgggggtaagggacgggtacgtaacggttacggttaacgtttaccggttaacgggaacccgttaccggggtcgggggtaaaccccggg

SEQ ID NO: 272572 - DNA, 635 bp, Homo sapiens
  misc_feature: GYAE6OF01CPNSO.21.76.G10.1.454.CMB.1.raw
  modified_base (323)..(323): a, c, t, g, unknown or other
  misc_feature (323)..(323): n is a, c, g, or t
  modified_base (490)..(490): a, c, t, g, unknown or other
  misc_feature (490)..(490): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
  modified_base (557)..(557): a, c, t, g, unknown or other
  misc_feature (557)..(557): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggtagtttggctgagtcttgggttttccttgttacttatttacaaaaggtgtccagtgtgaggtgcagctgggtggagacgtgggaggagtacttgactacccgtaaccggtcgggggtccctggacgtactcctccgtggtcgtcggttctcgtcggtcaccgtcactactaactccatcgagtcgtcgggtccnccgaggcctaccggaggggaacggggcgtagggtaggttcgggtctacgttagtttagtttagtagggttggtggttggtgagtagtagtaccgacaggtccgtacggtaggacgggtctagtccaacgctcctacgagtaacacctaattccaatacgaacacgtntacgtattctanaatcgaacncgtcaggacgacaccgacgtacgaccgtcttctagtcgtggccggnggacggggtgacgggtagggaagggtcgagtggtacgtacttacgttacggacccgtaagggggttccgggaacccgg

SEQ ID NO: 272573 - DNA, 733 bp, Homo sapiens
  misc_feature: GYAE6OF01DO3MQ.21.76.G10.1.454.CMB.1.raw
  modified_base (213)..(213): a, c, t, g, unknown or other
  misc_feature (213)..(213): n is a, c, g, or t
  modified_base (649)..(649): a, c, t, g, unknown or other
  misc_feature (649)..(649): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagcgtggtggagacgtggaaggngtacttgactaccgaaccgtcgggggtccctgacgtcctctccgtgtgcgtctcgttggtcaccgtcactacctacgtcatcgagtcgtcggccgcgacggaccgtccggaagggggtacgggcgtggtaggttcggtactacgttaagtttaatttaggtaggttgggtcggtggtgacctaggtacttacggactagtaaccgttcggtaacgggaacggtaccgtacttaccaaccgtcttaccgtaccgaagtaccgtaataaccgttccaagtacgaacctcgtacttaggtacttaccgtaacaagtacgaacgtacgtcgtaggaacgtaccgaaccggaccgtaacccggtaccggtaccgttacttaaccggtttaggtacggtcgggtacccgggggtaagggtacggggtacggggtaaaggggngggtaaacccggggagttacggttacggttaacgttaacgtttaacccgggaaccggttaacggggtcggggtaaaccccgggg

SEQ ID NO: 272574 - DNA, 715 bp, Homo sapiens
  misc_feature: GYAE6OF01D7K1B.21.76.G10.1.454.CMB.1.raw
  modified_base (520)..(520): a, c, t, g, unknown or other
  misc_feature (520)..(520): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaaggtgtccagtgtgaggtgcagcgtggtggagacgtggaggagtacttgactcccgaaaccggtcggggggtccctgacgaccttcctccgtgtgcggtctcgtggttccaccgtcactactaactccatgagcgtcgggtcccgccgaggccgtaccggaggggacggggcgtgggaggtcgggtctcgtagtttattagtaggttggtggtggtcgcgtagtacttacgcaacgtaccgtaccggtaggaaacgggtcccgtaacgttaccaaccctacgttcctacccgaaggacgtaactaactttcccaagtacgaacctacgtcttagttaacttaccttaanaaacgttacgaaacctacgtaccgtaggaacggtaccggacccgaaccggaacccgtaccgggacccttaacgttagttaccgtggttccggaccgggtaaggggtacggtaggggaaccgggggtagggacggggacctagggttaacggtactttaaccggttacggacccgtagggggttccgggggaaccg

SEQ ID NO: 272575 - DNA, 700 bp, Homo sapiens
  misc_feature: GYAE6OF01CD1MH.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcgttgggtttttccttgttactatttacaaaaggtgtccagtgtgaggtgcagcgtgggtggagacgtgggaggagtacttgactacccgaaccggttcgggggtccctgacgtacctcgtccgtggtcgtcggtcgtcgttcggtccaccgtcactactactcatgacgcgtcggtccgcgacggtccgtacggaggggacgggtcgtagggtacggttgggtccttagttaagtttatttagtaggttgggtggtggtgacgtaagtacgttacgctacgtaccgtcggtaggacggcctactccacctacgtctaccgaagaccgtacgtaacctacgaagtaacgacacgttcttagtaccgttactaacgaaagtcgaacgtcgacgtaggacgaccgaccgacgtacccggtaccgtcgttaccgtagttccggcggtcggaccgggtaacggggtaggtccgggggaaggggacggacgggtacgtaacgggttcggttaaacgttacggttaccggaacccgggttcggggtaacggggtaaccccgg

SEQ ID NO: 272576 - DNA, 670 bp, Homo sapiens
  misc_feature: GYAE6OF01CT9B7.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccgaaccgtggggggtccctgagactcgtcctgtgcggtctcgtggttccaccgtcactactaactccatgagcgtcgggtccgcaggccgtaccgaaggggagggcgtagggaggttgggtctctaagttattagtaggttggtggtggtcgtacagtagttacgacgtacgacctaccggtaggaagggtccgtaaactttccaaccgtaacttccgtaacccaagggtactaaaccgttaattacccgaagttacgaaacctaacggtcttagtaacttacttaacaaattcgaaacgcacctaggaaacgcgaccgtaaccgacgtaccgtcgttactagttacgtggtaccggacgggtagggagtaacggggaggggacgggtaagggacgtagttaacgggtaatttaacgttcgggaacccggtgggggtccgggggaaacccg

SEQ ID NO: 272577 - DNA, 893 bp, Homo sapiens
  misc_feature: GYAE6OF01DMP35.21.76.G10.1.454.CMB.1.raw
  modified_base (695)..(695): a, c, t, g, unknown or other
  misc_feature (695)..(695): n is a, c, g, or t
tcagtcgtcgctcgcacgaccggtgctcgatttagtcactcatacaggggctgggagaggagcccagcacgtgggattccggaggtgtttccattcggtgatcagcactgaacacagaggactcaccagtggtagttttggctagagtcgttgggtttttccttagttacttaatttacgtaaaaaggttgtcctaaggttggtaggtaggtcgacgtagtcgttgggtaggacggtagtaggggaggtagtactttgaccgttacccggtaacccgggttcggggggttaccctaggacgtaccttccgttccggtggtcgggtccggttccgtttccgggttcgggttaccccgtaacccggttacctaaacccttaaacccttaacccttaccgtaacggtcgacgggtccggttccggggtcccccgccggtaacgggtccggtacccgggaaggggggtaacggggtccgggttagggtacggttcgggttaaccgttagttttaaggtttttaagtttaaggttcggggtttaggggttcggtaacgggtcgtagacggttaacgtaaccgacgtacgtaccgtacggtacggacggtaccgtacttaccgacttctacgtacgaacgtactaacctactaccgataaccggactaccggtatttacacgtttacgaactaacggtaanacctcgacgtagaacggaccgacccggaagtaccgtcccggttactttacgttaggaccggttacgggaccgggtaaacgggtccggggtaagggtacccgggggaaagggaccgggttacgggtacttaaggggttaacgttaacccgtttccggggtaaaccggaccccgggtagggggcggggtaaaaccccggg

SEQ ID NO: 272578 - DNA, 799 bp, Homo sapiens
  misc_feature: GYAE6OF01EEAN4.21.76.G10.1.454.CMB.1.raw
  modified_base (143)..(143): a, c, t, g, unknown or other
  misc_feature (143)..(143): n is a, c, g, or t
  modified_base (209)..(209): a, c, t, g, unknown or other
  misc_feature (209)..(209): n is a, c, g, or t
tcagtcgtcgctcgcacgaccggtgctcgatttagtcactcatacaggggctgggagaggagcccagcactgggattccgaggttgtttccattcggtgatcagcactgaacacagaggactcaaccatggtagtttgactgngtcgtttcggttttccttagtttacttaattacgtaaaacggttcgtaccgtggtggtgtacggtnccgtaggtcgtgggtacgtaggtagtagggacgtaagcttcaaccgttcgggggtacccctgggtacctcgtactccccgttagtccgtcggttacgtcgtcgttcgtcggtactaccgtcctacctacctaactcgagctaggtccgccggtaccgaccgtccgacggtacggggactttagggtacgtacggtcggtacggttagtttacgttagtttggtagggctttagggttgtcggtagtacgttacgtacggtacgtacgtaccggttcgtaacggtaccggtaacgttaccggtaacccgtaacgtacctacccgtacctacgtaacgtaaactaccgtaacgttaccgaacgtaacgacgtaccgtaaacgtccgtacgtaaacgttcgaaaacccgtagccttaaggaaccgtacgccgtaacggaccgtaaccggcgtaccgttaacgttccgtacgtacgtccggtacgggtacggtaaccgggaggggtacggaacggggaacggtacgggtacggaacgttacggtacggtaacccgttacggtacggggtaacccgtacgggggtaaacccccgg

SEQ ID NO: 272579 - DNA, 802 bp, Homo sapiens
  misc_feature: GYAE6OF01DURBJ.21.76.G10.1.454.CMB.1.raw
  modified_base (586)..(586): a, c, t, g, unknown or other
  misc_feature (586)..(586): n is a, c, g, or t
  modified_base (675)..(675): a, c, t, g, unknown or other
  misc_feature (675)..(675): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccagtggtagttttggctgagtcgttgggttttccttgttacttatttacgaaaaggtcgtccgtaggtgtgaggtgcgagtcgtggtggagacgtgggaggagtacttgactaccgtaccgggtcggggtccctggacgtcctccgtcgtgtcggtcggttcgttcgttcggtaccgtaccgtactacgtaactactctagtcgtacgtcggtcggtccgccgacggcgtaccggacgggggacgggtacgtgggtacgggtcggtacgttacgttaagtttagtttaggtaggtgggttgggtggtacgtacgtaaggtacttccggacgtacggtacgtccggtaggtaccggaccttacgtaccgtacgtaccgtaccgtaccgaaggtaacgtaaccttaacgttacccgtaagtaaccgaaccgtacggttcgttagtttaaaccttaccgttaaanaaacgtaacgaacccgtaagtcccgaaggtaccgggaaccgtacccggacgttaacccggtcccgtacgtttaacgttacgttaccggnggtacggaccggggtaagggtacggggtacggggaacggggtagggtaccgtagggtaacggttaccgttaaaccggttaccgggtaacggaacccggggttaggggtaacccggggtaaaccccgg

SEQ ID NO: 272580 - DNA, 814 bp, Homo sapiens
  misc_feature: GYAE6OF01BD5UU.21.76.G10.1.454.CMB.1.raw
  modified_base (183)..(183): a, c, t, g, unknown or other
  misc_feature (183)..(183): n is a, c, g, or t
  modified_base (697)..(697): a, c, t, g, unknown or other
  misc_feature (697)..(697): n is a, c, g, or t
  modified_base (750)..(750): a, c, t, g, unknown or other
  misc_feature (750)..(750): n is a, c, g, or t
tcagtcgtcgctcgcacgaccggtgctcgatttagtcactcatacaggggctgggagaggagcccagcactgggattccgaggtgttccattcggtgatcagcactgaacacagaggactcaccatggtagttttggctgagtcttggtttccttgttactattacaaaggtgtccagtgtgnggtgcgagcgtggtggagacgtggaggagtacgttgacgtacccgaaccggtcgggggtccctaggtacgtacctcctccgtgtcggtccggtacgtccgtcgggttccaccgtctaccgtaaccgttaactccgagtgacgtccggtcgggtcccgaccgacggtccgtacccggaaggggaacggggtcgtacgggtacggtcgggttaccttcggttaagtttaacgttttagtagggttagggttgggtggtcgtacgtaagtacgttaccgagaacgttacccgtacggtacggtaaacgggtccctaagtttaccccgaaccgtacgttcccgaaccgtaaggtaacgtaaccgttaccttaaccgtaggaaccgtaaccacggtcctttaacgttactttaacgttaaccctaaagttaccgaacgtcccggtaacccgttagggaacccgtacggacccgtaaaccgggaacccgtaaccgtccgttaacgttacttaacccgggngttaccggaaccggggtaaggtccggtaacgggaccgggacgggttaacgggngtaaacgggttcggtaaaccgtttacgttacccgggaaccgttaggggacggggtaaccccggg

SEQ ID NO: 272581 - DNA, 758 bp, Homo sapiens
  misc_feature: GYAE6OF01C8JHE.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcgttgggttttccttgttactatttacaaaaggtgtccagtgtgaggtgcagcgtggtggagacgtggaggagtacttgactacccgtaaccggtcgggggtccctggacgtactctccgtgtcgcggtctcgtcggtccaccgtcactactactcagtgacgcgtcggtccgccgaggccgtacggaggggaacggcgtagggaggtcggtctacgttagtttagtttagtaggttggtagggtggtagacgtaaggtaactaccggacgtacgtaccggtaccggtagggaaccgggtacccgttataacccgtaaccgtaccgttacctaaccgaaggaacctaaccgtaactttaccaagttaccgaaaccgtaccgttacgttacgttaaccttacgttaaactaaacgttaacgaacgtaaccgtaccgttaaggaaccggtaccggaacccggaaccgaacccggtacccgttaccgttaacgttaccgttacgtacgggtacggacccgggtaagggtaccggtaaggggacggggtacgggacgtacgtaggtaacggttacttaacggttaccggaaccggtcggggtacggggtaaaccccgg

SEQ ID NO: 272582 - DNA, 794 bp, Homo sapiens
  misc_feature: GYAE6OF01DBQ56.21.76.G10.1.454.CMB.1.raw
tcagtcgtcgctcgcacgaccggtgctcgatttagtcactcatacaggggctgggagaggagcccagcactgggattccgagtgtttccattcggtgatcagcactgaacacagaggactcaccatggagttttggctgagctggttttccttgttactatttcaaaaggtgtccagtgtgaggtgcgagctggtggagtacgtgggaggacgtacgttgactacccgtaaaccggttcgggggtccctgacgtacctctccgtgtcgtcgtctcgtcgggttccaccgtcaaccttactaacctcagtcgagtcggtacggtcccgaccgtacggtcctaccggaaggggtacggggtcgtagggtaggtcgggtacttacgttaagtttacgtttaggtaggttgggttgggtaggtcggactaggtaacgttacggctaaacggtcccgttaccggtaaggaccgggtactacgttaccacccgtactcctaaccgacgtaacgaaccttaacgtaccgtaattccgaaaccaccggtactttagttacgttaacctaactaaacgtcgaaacgacggttacctaaggaacggtacccggaaccggtaacccggtacgtacccgggttaccccgttaaggttaccgtttaacgtccggggtacgggaaccgggaacggggttaacgggtggggtaaccggggggtacgggaacggggtaccgtacgggtaccggttaacgtttaaccggtttccggaaacccgttaccggggggttaggggaacccccggg

SEQ ID NO: 272583 - DNA, 816 bp, Homo sapiens
  misc_feature: GYAE6OF01BYL9Q.21.76.G10.1.454.CMB.1.raw
tcagtcgtcgctcgcacgaccggtgctcgatttagtcactcatacaggggctgggagaggagcccagcacgtgggattccgaggtgtttccattcggtgatcagcactgaacacagaggactcaccagtggtagttttggctgagtcgtttgggttttaccttgttacttatttacgaaagtcgtccgagtgtagaggtgtcgagtcggtgggtaggacgtacggtagggacggagttacgttacgtacgttacccgaaccgggttcgggggtacccgtcggacgtaccgttccgttccgttggtcggtcggtccgttccggttcggttccgtaccgtactaaccttaacctaacctaccgagtacgacgtcggtcggtacccgcgacggtcgacgggacgggaggtcgtaggtaggttcgtacgtagttagtttagtttagtaggtgggttggtcgtacgtagtagtacgtaacggacgtacgtcgtacggtaggaaccgtcgtaaactaccgacgtacgtcgtaaccgaaggtaactaactaaccgtacgtaagtaaccgaacgttacccgtagtttactaacgttaacccttaagaaacgtaacgtaaccggtacgtaccggaacggtaccgtaaccgggaacccggtaccgaaccggtacccgttaaccgtttactaccgttaggacgggtaacggacccgggtaagggggtacgaacgggggaacgggtaaggggacggaaacgtacggttaaccgggtaaatttacccgggtaacgggtaccggttagggggaacccgggtaaacccggg

SEQ ID NO: 272584 - DNA, 817 bp, Homo sapiens
  misc_feature: GYAE6OF01BQ5R2.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcgttgggttttccttgttactatttcaaaaggtgtccagtgtgaggtgcagctggtggagacgtggaggagacttgactaccgaaccgtcggggggtccctaggacgacctctccgtgtcggtcgtctcgtggttccaccgtcactactaacctccagtgagcgtcgggtcccgccgacggccgtaccggaaggggacgggtcgtagggtacggttcgggtactacgttaagttttaagttttaaggttagggttcggggttgggttgggtacgtacgtaacgttaacggtttaccgacgtaacggtacccgttaccggtaaggggtaaaccggggtcccgttaacgtttacccaaaccgttacgttacccgtaaccgaaaggtaaccgtaaccttaaactttacccgaaagtaacgaaccctacgtccgttagtttaaccttaccgttaaacaaacgttacgaaactaccggacctagggaaccgtaacccggaacccggtaaccgtaccggtacccgggttacctttaacgttacgttaccggtcggaaccgggtaccgggtaaagggggtcggtaaacgggggaacgggggagggtaccggacgttaaggttacgttaaaccgtttccggttaaacccggaccgggttacgggggcgggggtaaaccccgg

SEQ ID NO: 272585 - DNA, 883 bp, Homo sapiens
  misc_feature: GYAE6OF01DY1WJ.21.76.G10.1.454.CMB.1.raw
tcagtcgtcgctcgcacgaccggtgctcgatttagtcactcatacaggggctgggagaggagcccagcacgtgggattccgaggtgtttccagttcggtgatcagcacgtgaacacagacggactcaccagtggtagttttggctggtagtcgtttcgggtttttccttagtttagtttaagttttaggaaggttcgtaccgtaggttgtaggagggttcgcgtacgtcggttgggttagggacggttcgggtaggggggcgttcggttcggccgacgggtccgggttacgggggtcctaggagtacgtcgtcggtgtggtacgtcctgtagtattacttaacgttactcgttagtagagtacgagtcgttcgggacctccggtaggtaccgtaccgggaggggtaacggtcggtagggtacgggtacggtacgaaaccgtaaagaaggtaaaaggtagaaggtaaggtaaggtaacgtaaacgtaaaggtcgtaggtacgtactacggtaggaacggtaaccggcgtttactaccgtaacgttacgttacgacggaacgtaaccgaaccgtaaaccgtaaccggtaaacgtaaacccgtttacgttttaaccgttaccgtaacggtacgtaaaacgttaacgttaaccggttaaacgtaccgtaacggtaacggtaaccgttaacgggtaacccgaaacggggttccccgagggtttacttaacgggttttacgttaacccgttggtaaccggtagtaaccgggtaaagtaccggtaaggtaaacggggtacggtaaacgggggttaccgggaagtaacccccggggttgtaaccggttttaccgtaccggtttttaaacgtacgttttaccgggtaaaccg

SEQ ID NO: 272586 - DNA, 586 bp, Homo sapiens
  misc_feature: GYAE6OF01EXBO5.21.76.G10.1.454.CMB.1.raw
  modified_base (296)..(296): a, c, t, g, unknown or other
  misc_feature (296)..(296): n is a, c, g, or t
  modified_base (534)..(534): a, c, t, g, unknown or other
  misc_feature (534)..(534): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgatccgaaccgtggggggtccctgagactctcctgtgcggtctctggtccaccgtcactactaactccatgagctgggccncaggctccgaggggaagggctggaggtggtctcaggttattagtaggtggtggtggtgcgagagttacgctaggactccgtagaagggcctatcaccatctccagacgacaatttcccaataggaactaccgctagtacttcgttacaaatcgaaacaggcctgaacggacgacccgaccgggacaccggtcctagtacttacgtgtgaccgggagggtagagggtaacggggagggngggacctagtagggtacttaccgtttaggaacccgtaggtgggggaaacccg

SEQ ID NO: 272587 - DNA, 814 bp, Homo sapiens
  misc_feature: GYAE6OF01AI0AK.21.76.G10.1.454.CMB.1.raw
tcagtcgtcgctcgcacgaccggtgctcgatttagtcactcatacaggggctgggagaggagccccagcactgggattccgaggtgtttccattcggtgatcagcactgaacacagaggactcaccatggtaggtttgctgagtcgttggttttccttgttacttattacgtaaaggtgtcctagtgtggaggtgtcgagtcgtggtggacgacgtagggaggactacgggggggggggttactaccgtacccgtaaccgggttcgggggtcccgtacggtacgtaccgttccgtccgttcggtcggtcggtcgttcgtcggttccgtaccgtacctaactacctacctaccgtacgtacggtcgtccggtcggtccggccggaccggtccggacggtacggggacgggtcggtcgggtaggttcggtacgttacgttaagtttagttaggttaggttgggttggtacggtacgtacgtacgtacgtacgtacgtaccgtacgtacggtacggtaccggtaccgtacgtaccgtaaccgtaccgtccgtacgacgtaacgtaccgtaactacgtaacgtaaccgtaaccgtacgttacttacgttacttactaaacgtaagtaccgtaacgtacgtaccgtacggacgaccggaacccgtaaccggtaaccgacccgttaacccgttaacgttacgtaccggtcgtaccgggacgggaacgggaacggtaacggggacgggtacggggtacgtacgtaagggttaccgttaacggttaccgtaccggtacgggttaccgggcgggttaacccgg

SEQ ID NO: 272588 - DNA, 701 bp, Homo sapiens
  misc_feature: GYAE6OF01A8TUV.21.76.G10.1.454.CMB.1.raw
  modified_base (190)..(190): a, c, t, g, unknown or other
  misc_feature (190)..(190): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatgggagttttggctgagcgtgggttttccttgttactatttcaaaaggtgtccagtgtgaggtncgagcgtgggtggagacgtgggaggagacttgactccgaaccggtcggggggtccctagacgtactctcctgtgcgtctcgtggtcaccgtcactactactcntgancgtggccncaggctccgaggggagggctgggaggtgggtctcgtagtttatttagtagggttgggtggttgggtgacgtagtacgtttaccggacgtaacgtaccggtccggtagggaaccggggtccgttaacgttacccaaccgtacgtacccttacgaagtaacgaacctaacttccgaagtacgaacctacgtctagtacttcttaacaagtacaacgcgtctaggacgacgtacccgacggtaccgtccggtaccgttacttaacgttcgtcggtacggacccgggtaggggtaacggtccggggaacggggaggggtaacggtaccgtagggttacggttaacgtttacccggtttaagacccccggggttgggggtaccgggggtaaacccccgggg

SEQ ID NO: 272589 - DNA, 699 bp, Homo sapiens
  misc_feature: GYAE6OF01BXNW8.21.76.G10.1.454.CMB.1.raw
  modified_base (393)..(393): a, c, t, g, unknown or other
  misc_feature (393)..(393): n is a, c, g, or t
  modified_base (584)..(584): a, c, t, g, unknown or other
  misc_feature (584)..(584): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagtcttgggttttccttgttactatttacaaaaggtgtccagtgtgaggtgcagctggtggagacgtggaggagtacttgactaccaaccggtgggggtccctgagactctctgtgcgtctcgtggtccaccgtcactactaactccatgagcgtcggtccgccgaggccgtccggaggggaacggggcgtgggaggtcgggtctacgtagtttatttagtaggtgggtggtggtgacgtagtacgttacgngtacgtaccgtacggtaggaacggggtcctaagttaccaaccgtattcccgtaacgagaacgtaacctaacttaccgaagtacgaaacctcgtccttagtaacttccttaaacgaaacgtacgaaacaccggtcagggtaacggaaccggtccccaacgggtacctacccgggtcttacgttattaccggnggtacgggaccgggtaagggggcgttagggggaacccggggaaggggcgggtacagggtacggttaaacgtttccggttaacggacccgggtacgggggtgggggtaaaccccgg

SEQ ID NO: 272590 - DNA, 771 bp, Homo sapiens
  misc_feature: GYAE6OF01EKAFK.21.76.G10.1.454.CMB.1.raw
  modified_base (208)..(208): a, c, t, g, unknown or other
  misc_feature (208)..(208): n is a, c, g, or t
  modified_base (648)..(648): a, c, t, g, unknown or other
  misc_feature (648)..(648): n is a, c, g, or t
  modified_base (689)..(689): a, c, t, g, unknown or other
  misc_feature (689)..(689): n is a, c, g, or t
  modified_base (761)..(761): a, c, t, g, unknown or other
  misc_feature (761)..(761): n is a, c, g, or t
tcagtcgtcgctcgcacgaccggtgctcgatttagtcactcatacagggctgggagaggagcccagcacgtgggattccgaggtgtttccagttcggtgatcagcactagaacacagtagacctcgaccagtaggtagttttggctgagtcgttcggttttccttagttacttattacgaaagtgtccagtgtgtagtgcagtgtggnggagtacgtggaaggtagtacttgtaccgtaccgtaaccggttcgggtcctagaccgtacttccgtcgttggtcggtccgttacgttccgttacggtccgtaccgtacgtaacgttaacctaacctacctagtaccgtacgtccgtaccggtcccgaccgtacggtaccggacggtaacggggtaccgggtcggtagggtacggtcggttctacgtttagtttaaggttagttaacgggtggttacggtaggttacgtacgttaagtacccgttagtacgtaccggtaaccggttccggaacgggttaaccggtaccttaacgttacccgtaccttacgtacccgtaaccgaacgtaaccgtaactaacgtacctaagtaaccgtaacgtacgttaacgtcgttaacttacgtaataaccgtataaccgtacgtaccganaccggaactaccgacgtaccgtacgtaccgtgtaaccgtgnggtaggcgaaggtggtaaggacgggtaggtggtaaccgttgtacgtacgttacggtaccgtacggtccgggnggtacccggg

SEQ ID NO: 272591 - DNA, 713 bp, Homo sapiens
  misc_feature: GYAE6OF01ARW3V.21.76.G10.1.454.CMB.1.raw
  modified_base (336)..(336): a, c, t, g, unknown or other
  misc_feature (336)..(336): n is a, c, g, or t
  modified_base (410)..(410): a, c, t, g, unknown or other
  misc_feature (410)..(410): n is a, c, g, or t
  modified_base (503)..(503): a, c, t, g, unknown or other
  misc_feature (503)..(503): n is a, c, g, or t
  modified_base (635)..(635): a, c, t, g, unknown or other
  misc_feature (635)..(635): n is a, c, g, or t
tcagtcgtcgctcgcacgaccggtgctcgatttagtcactcatacagggctgggagaggagcccagcactgggattccgaggtgtttccattcggtgatcagcactgaacacagaggactcaccatggagttttggctgagcttgggttttccttgttactatttcaaaggtgtccagtgtgaggtgcagcgtggtaggagacgtggaggagtacttgactccgaaccggtcggggggtccctgacgtacctcgtccttggtcggtcggttcttcgtgggttaccctaccgtacctaccgttactaacctcctaagtcgaacgtcgtcgggtcccncgacggtcgtaccggaggggacggtcgtggaggtcggttactcgtagtttacgtttagtaggtggtggttaggngtacgaagtacgtaccgcgtaagtccgtcggtacggaacgggtcgtacttaccactacgtcctacgagacgaactacgtaccagtacgtaacnccgtactactattacgtactaagtacgaactacgcgtaggtaacgacggacccgaacgtaccgtaccggtaccgttacttacgttaccgtacggtcggtacgggtacggggtacgggacggggtaacggggngggaacgggtacgtaaggttacgggttaacgtttacccgttacgggacccgtacgggggtccggggtaaaccccgggg

SEQ ID NO: 272592 - DNA, 975 bp, Homo sapiens
  misc_feature: GYAE6OF01C9M0E.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccagtggtagttttggctgagtcgttgggttttcctttgtttaacttattttacgaaaaaggttgtcctagttgtgaggtgcagtcgtgggtaggagacgtggaggtagtacgttagactcccgtaaccggtcggggggtccctgacgaccttcctccgtgtcgtccggtcgtacgttcgggttccaccgttaccaaccttaaccgttaaacctccagtacggacgtaccggtccggggttaccccgccgtacggtcccggtaccgggaagggggtaacgggggtcgttaggggtagggttacgggttcttcctttaaaggttttaacgttttaggttaacgggttggggtacgggtttggtacggtacgtagttacgttaccggacctaacggtacccggtaccgggtaggggaaacccggggtccttaacgtttacccgtaacctaacgttacccgtaccgaacgttaacgtaaacgttaaccttaccgtaagttaaccgaaaccggtacttcgtttacggtattttaacccgtaagtaaaacgttacggtaaaccgtacggtaaccccgttagggaaacccgggtaccgtaacccccgggaacccggtaaccccggtaacccggggtaaccccgttttaaccgttaaacggttttccgggtacggggttaaccccgggcgggggtaaaaccggggggtttcggggttaaaacccggggggacggggggtaaaccgggggtaggtaaacccggggttggttaaacccggggttttaaacccgtttaacgggttttccccgggggaaaccccggtttaaggggggtacccgggggggtaaaaccccccggg

SEQ ID NO: 272593 - DNA, 774 bp, Homo sapiens
  misc_feature: GYAE6OF01BK01R.21.76.G10.1.454.CMB.1.raw
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (586)..(586): a, c, t, g, unknown or other
  misc_feature (586)..(586): n is a, c, g, or t
  modified_base (626)..(626): a, c, t, g, unknown or other
  misc_feature (626)..(626): n is a, c, g, or t
tcagtcgtcgctcgcacgaccggtgctcgatttagtcactcatacaggggctgggagaggagcccagcactgggattccgaggtgttccattcggtgatcagcactgaacacagaggactcaccagtggtagttttggctggagtgttcgggttttccttgttacttattacgaaaggtcgtcctagtgtgtaggtgcagtcgtggtggagtacgtaggagggagtacttgactacccgtaaccggtcgggggtccctaggacgtacctctcgtggcgtcggtctcggtcggttccaccgtactaactactaacctctagngtagtccgtcggtcccgacgnggtaccgacgggagggacgggtcggtaggtaggtcggtactagttagttacggttaagtagggttcgggtagtgggtcgtaacgtaacgggtaattaacggcgtacgtacggtaaccggtaacgggaaccgggtcctaactaacccgtaccgtaaactcctaccgaataacggtaacttaaccgtaacgtacgtaacgaaccgtacgtcgtaactactttacctaactaacgtacgaactaacnccggtagaacgacgaccggacctaacggtcccgttaactntaacgttcgtacggtccggtaacgggtaaacgggtcggggaacgggtaaccggggagggggtaacggtacggttaaggttacggttaaccggttaccggttaaccggggaaccggttacccggggggttcggggtaaaacccccgggg

SEQ ID NO: 272594 - DNA, 681 bp, Homo sapiens
  misc_feature: GYAE6OF01EWCI8.21.76.G10.1.454.CMB.1.raw
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (505)..(505): a, c, t, g, unknown or other
  misc_feature (505)..(505): n is a, c, g, or t
  modified_base (618)..(618): a, c, t, g, unknown or other
  misc_feature (618)..(618): n is a, c, g, or t
tcagtcgtcgctcgcacgaccggtgctcgatttagtcactcatacagggggctgggagaggagcccagcactgggattccgaggtgtttccattcggtgatcagcactgaacacagaggactcaccatggagtttttggcgtgagtcttgggttttccttgtttactattttacgaaaaggtgtccgtaagtgtgaggtgcagtcgtgggtgagacgtggaggagacttgactccaaccgtggggtcctgngactctctgtgcgtntcgtggtcaccgtcactaacgtactcatgagcgtcggccnccgaggcctacggaggggagggcgtgggaggttcgggtactcgtaagtttacgtttagtggtagggtgggtggtgacgtagtacgttacgccgtagaccgttccggtagggtaacgggtccttagtacccaacgtacgtcctacgagaacgtaacctagttaccagttaaccacgacgtacttcgtactttaccgttanaagtagaaccctgcccgtagggaacgaccggacccgaacggaccggtacccggttcgttaccttaggttcgtacggtccgggacgggtaacgggtggtacggggaaacggggngggaacggaccgtagttcgggtaaactttccggtaaccggacggttacgggccggggtaaacg

SEQ ID NO: 272595 - DNA, 778 bp, Homo sapiens
  misc_feature: GYAE6OF01A9KDU.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtctgggttttcctgttactatttcaaaaggtgtccagtgtgaggtgcagctggtggagactggacggagacttgataccgaaccgtgggggtccctgacgactcgtcctggtacgcggtctcgtgggttccaccggttcacctactaacgtccaatgagcgtcgggtcccgccgtaaggcctaccggaggggacgggcgtagggagtcgggtctagtacggtttaatttaggtaaggttcgggtgggttgggtagtccgtaaaggtactttaccggacgtaaggaccttccggggtaggaaaccgggggcccttaacggttccaaccctacgttccgtaccgacggtaacgaaccgtaacgttacccgtaagtaaccggtaaaccgaccggttaccgtacgttaaccgtttacccgttaacgtaaaacgttaccggtaaacccggtcggaacccccgttaggaaccggtaaccggtcccggaacccgaacgtaccccgggttacccgtttcgtaacgttaccgtcggtagtacccgggaacggggttccggttaacgggaacccggggtaggtaccgggccgtaaggtacggttacgttaccgttaacggaccccgtcgggttcgggggaccccgg

SEQ ID NO: 272596 - DNA, 547 bp, Homo sapiens
  misc_feature: GYAE6OF02G7643.21.76.G10.1.454.CMB.1.raw
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (489)..(489): a, c, t, g, unknown or other
  misc_feature (489)..(489): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgagactctcctgtgcggtctctgggttcaccgtcactactaactccatgagctgggtccgccgaggcctccgaggggaacggggctgggaggtgggtctcgtagttatttagtaggtgggtggtggtgcgagattacgcagacgtccgtaggaacgggccgattcaccatctccagacgacaattccatagaacacgctagtactcttanaaatgaacngcctgagacgccgacgacacggcctatacgttacngtgcgagggagtggacgggaggcggcagtggacttacgttgaccgtaggtggggaccg

SEQ ID NO: 272597 - DNA, 529 bp, Homo sapiens
  misc_feature: GYAE6OF02ID2MS.21.76.G10.1.454.CMB.1.raw
  modified_base (295)..(295): a, c, t, g, unknown or other
  misc_feature (295)..(295): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccncaggctccaggggaaggggctgggagtgggtctcagttatttatagtggtggtggtgcagattacgcagactccgtgaagggccgattcaccatctccagagacaatccatgaacacgctgtattcttacaaatgaacagacctgacgagccgacgacacggccgtctacttactgtgcgacgggagtcggacgggagggagggcagtggatacgttgacctacgtggggaccg

SEQ ID NO: 272598 - DNA, 529 bp, Homo sapiens
  misc_feature: GYAE6OF02HBWFX.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcggtctctgggttcaccgtcactactaactccatgagctgggtccgccaggctccgagggaagggctgggagtgggtctcagttattagtagtggtggtggtgcagattacgcagactccgtgaagggccgattcaccatctccagagacaattccatgaacacgctgtatcttacaaatgaacagcctgagacgccgacgacgacggccgtctattactgtgaccggagggagtggacggggaggagggcagtggattacgttgaccaggtggggacg

SEQ ID NO: 272599 - DNA, 611 bp, Homo sapiens
  misc_feature: GYAE6OF02FGUKM.21.76.G10.1.454.CMB.1.raw
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtggttttctgttacgtattcaaaagtgtcagtgtgaggtgcagctggtggagactggaggagacttgatccaacctggggggtcccctgagactctcctgtgcggtcnctgggttcaccgtcactactaactccatgagctgggtccnccaggctccgagggaagggctgggagtgggtctcagttattataggtggtggtggtgcagattacgcagactcgtaggaaggccattcaccatcctccgagacgacaaattccatacgaaaccacggctaggttaactcgttacaaagtgaaacagtacctagacgacgcccggaacgaaccgaccggtaccgtacttaacgttaacgtggtacgacggaaccggggtaggtacgggaaccgggggtaaggggacgggtaccaagggttgggtaacgtttaaccgtttaggaaccccgtacgggttcggggggaacccg

SEQ ID NO: 272600 - DNA, 597 bp, Homo sapiens
  misc_feature: GYAE6OF02GPMLZ.21.76.G10.1.454.CMB.1.raw
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccgaaccgtggggggtccctgagactctcctgtgcggtctcgtggttcaccgtcactactaactccatgagcgtcggtccgccacggccgtccgaggggaacggggcgtggagtgggtctcgagttagtttagtagtggtggtggtgcgagtattacgcagacgtcgtgaacggcgattcaccatctccagagactaattccatacgaacncgctgtatcttanaaatgaacngacctagacgacgccgaacgaccgacgggtccttataacttacgtcggtcggacggaacggggagttacggggaaccgggggtagggacgggctagggttacggtacgtttaacgtttcggaacccgtacggggtgggggaacccgg

SEQ ID NO: 272601 - DNA, 654 bp, Homo sapiens
  misc_feature: GYAE6OF02F7GW8.21.76.G10.1.454.CMB.1.raw
tcagtcgtcgctcgcacgaccggtgctcgatttagtcactcatacaggggctgggagaggagcctagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcgtctctgggttcaccgtcactactaactccatgagctgggtccgccgaggcctccggaggggaaggggctgggaggtgggtctcgagtttattataggtgggtggtggtgcagtattacgcagactccggtaggaacgggccgtattcaccatcctaccgaagacgaactaattcccgaattacgaaaccacgcgttagtaacttccttacaaaattcgaaaacctacggtcctaggaacggaacgtccccgggaaacgacccgaaccgggtcccttaaccgttatttaaccgtgggtcggaccgggtaacggggacggttgggggaaccggggtaagggacggggtaccaaggttcgggaactttaccgttcggaacccgttacgggtcggggggaacccgg

SEQ ID NO: 272602 - DNA, 597 bp, Homo sapiens
  misc_feature: GYAE6OF02G3T47.21.76.G10.1.454.CMB.1.raw
  modified_base (418)..(418): a, c, t, g, unknown or other
  misc_feature (418)..(418): n is a, c, g, or t
  modified_base (492)..(492): a, c, t, g, unknown or other
  misc_feature (492)..(492): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctcgtgggttcaccgtcactactaactccatgagctgggtccgccaggctccgagggaacggggctggagtgggtctcgagtttattataggtggtggtggtgcagattacgcagactccgtgaacgggcgatcaccatctaccagagacaattccatacgaacncgctagtacttcttacaaatgaacagcctagacgacgacccgaacgtacaccgggtccttcttaacgtttaccnggttacggacggtaacgggggtcgtaacggggaacgggggaaggggtacgggacaggttgggtaacttaccggtttacggacccgtacggggtcgggggaaccgg

SEQ ID NO: 272603 - DNA, 695 bp, Homo sapiens
  misc_feature: GYAE6OF02GF438.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcgtctcgtgggttcaccgtcactactaactccatgagcgtggtccgccgaggcctcgaggggacgggctggaggtgggtctcgtagtttattagtaggttggtggttggtcgcgtaagtattacggacgaacgtaccgttccggtagggaacggggtcccgtaagtttcccgaaccgtacttcccgtaccgaaaggtaacgtaaccttaaacgtttcccaagtacggaaaaccctcggtacttagttaacttccgttaacaaaacgttcgaaaactcggtacccttaggaacggacgacccggaaccgtacgtaacccgggtccttaaccttaatttaccgtgggttacggaccgggtaacggggagttcggggaaccggggagggtaacgggtctaaggtacggtaactttaccgttcggacccgtacgggtcgggggaacccg

SEQ ID NO: 272604 - DNA, 674 bp, Homo sapiens
  misc_feature: GYAE6OF02J3RNB.21.76.G10.1.454.CMB.1.raw
  modified_base (374)..(374): a, c, t, g, unknown or other
  misc_feature (374)..(374): n is a, c, g, or t
  modified_base (526)..(526): a, c, t, g, unknown or other
  misc_feature (526)..(526): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccagtggtagttttggctgagtcgttgggttttccttagtttacttatttacgaaaaggttgtccagtgtgaggtgcagcgtggtggagacgtggagtagtacgttagactccgtacggtcgggggtcctgactctctcgtgtcgtcgtctcgtcggtccacgtcactactactcatgacgtcgtcggtccgcgcgcgacggagggaggtcgtggagttggtactagtagttagttggtaggtggtggtgngagtaacgtctacgtacgacggtaccgtcggtacgggacggtacctactacctactcgtacgtacccgtaagacgtaaacttaaccgtaccgtaagtaccgaaaccgttctacgttacgttaacctacgtaaattaacgaccgaactcggtntacggacgaccgacccgtacgacccgtaccgttcgtacttaagtccggtaggacccgggttacggagggttacggcgggtaacggggacgtacggacttagggtacgtacgttaccccggtaggacccggtaggggaccggtaaccgg

SEQ ID NO: 272605 - DNA, 560 bp, Homo sapiens
  misc_feature: GYAE6OF02FGYP4.21.76.G10.1.454.CMB.1.raw
  modified_base (300)..(300): a, c, t, g, unknown or other
  misc_feature (300)..(300): n is a, c, g, or t
  modified_base (460)..(460): a, c, t, g, unknown or other
  misc_feature (460)..(460): n is a, c, g, or t
  modified_base (464)..(465): a, c, t, g, unknown or other
  misc_feature (464)..(465): n is a, c, g, or t
  modified_base (491)..(491): a, c, t, g, unknown or other
  misc_feature (491)..(491): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactgggaggagacttgactccaaccgtggggggtcccctgagactctcctgtgcggtctctgggtcaccgtcacttactaactccatgagcgtgggtccnccgaggcctccgaggggaacggggctgggaggttcgggtctctagtttatttataggtggtgggtggtgcgtagtacttacgcacgacgtccgtaggaacggggccattccactactctaccagacacaacttcatcgaacacgtctgtatcttacaatnaacnncctgagacgccgacgaccacggcctntattcgtgtgcggacggaggtggacgggaggaggcgagtggacttacgtttgaccgtaggtcgggtacg

SEQ ID NO: 272606 - DNA, 686 bp, Homo sapiens
  misc_feature: GYAE6OF02H3WKY.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagacgtgggaggagacttgatccaaccgtggggggtccctgagacctctctgtgcggtctcgtggttcaccgtcactactaactccatgagcgtcgggtccgcgacggctccggaaggggaacgggcgttagggtacggtcggggtctacgtagtttagtttagtaggttgggtgggtggtgacgtagtacttacgcgagtacgtccggtaggaacggtcgattccaccgtactccgtaccgaagtaacgaacctaagtttcccaaagtacgaaaccgtaccgtcgttagttaaccttcttaacgaaagtcgaacagtaccgtagacggaaccgccggaaccgaccgtacccgggtacccgtttagtaacctttacgtggtaccggaccgggtacggggtagtaggggaaccggggtagggacgggtacctagggttcggtaacgtttccggtttacggaacccggttacggggtacgggggtaacccg

SEQ ID NO: 272607 - DNA, 695 bp, Homo sapiens
  misc_feature: GYAE6OF02GBT1L.21.76.G10.1.454.CMB.1.raw
  modified_base (185)..(185): a, c, t, g, unknown or other
  misc_feature (185)..(185): n is a, c, g, or t
  modified_base (201)..(201): a, c, t, g, unknown or other
  misc_feature (201)..(201): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (622)..(622): a, c, t, g, unknown or other
  misc_feature (622)..(622): n is a, c, g, or t
tcagtcgtcgctcgcacgaccggtgctcgatttagtcactcatacagggctgggagaggagcccagcactgggattccgaggtgtttccattcggtgatcagcactgaacacagaggactcaccagtgagtttggctgagctggttttcctgttactatttcaaagtgtccagtgtgagtgcagntgtggagctggagganacgttgatccaaccgtgggggtcccctaggacgacttcctcgtgtggccgtcttcgtaggttccaccgttcacgtacaaccttccaatggactcgtggtcccgcaggcctccggagggaagggtctggaggttggttcacgtagtttagttagtaggtgtgggtaggngactaggtacttacgganaacgtacgttccggtaggaacggggtaccccgtattacccgaaccgatttccccgacgtaacgaaccgtacgtaaaccttaccgtaataaccggtaactaaccgtaccgttaggttaccttaccgtttaactaaaacgttacgaaaccgtaacgtaccgtacggtaagaacccgtacgaacccgtaccgaccggtacccgttacctaagtaccgttgtacgtaccggtaaccggngggtaacggacggtacggggaacggtagacgtaggtacgttaaccgtttaggaccctagggtaccgggaccgg

SEQ ID NO: 272608 - DNA, 608 bp, Homo sapiens
  misc_feature: GYAE6OF02IY76U.21.76.G10.1.454.CMB.1.raw
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
  modified_base (433)..(433): a, c, t, g, unknown or other
  misc_feature (433)..(433): n is a, c, g, or t
  modified_base (463)..(463): a, c, t, g, unknown or other
  misc_feature (463)..(463): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgagactctcctgtgcgtctcgtggtcaccgtcactactaactccatgnctgggtccncgaggctccgaggggaggggcgtggaggtgggtctcagttattagtagtggtggtggtgnagtagttacgcagctccggtggaacgggcgtacgttccaccgtatcctacccgaggaacgacaacttccagtacgaaacncgtctgttaactcttaacaaattcgaaacncgtaccttaggaacgtacggacccgaacgaccgtaccgggccttactaacttacgtggacgtacggacgggtaggtacgggaacggggaggacgggactagttagggaccttaccgttacggaacccgtagggtccggggaaccg

SEQ ID NO: 272609 - DNA, 728 bp, Homo sapiens
  misc_feature: GYAE6OF02IXHR8.21.76.G10.1.454.CMB.1.raw
  modified_base (294)..(294): a, c, t, g, unknown or other
  misc_feature (294)..(294): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagtttggctgagctgggttttccttgttactatttcaaaaggtgtccagtgtgaggtgcagctggtggagactggaggagtacttgatccgaaccgtggggggtcccctggacgactcctccgtgtcgcggtctcgtgggttcaccgtcactactaactcatgancgtggtccgcaggctccgaggggacgggctgggaggtgggtctcgtagtttatttagtaggttgggtggtggtgcagtacttacgctagcgttaccggtaggaacgggcccgtaagtttacccaacctacgttccgttacccaacggaacggtaacctaaacgtttcccaacgttaacgaaaccacggtaccgttacggttacttactttaccgaaaattaccgaaactacggacccgttaggaaccggtacggacccgacggaacccgtaaccggggtaccccgttcgttaaaccgtttaacgtcgggttaccggtacgggtaacggggtacgggttacggggaaccggggtaagggggtacggggtacgtacggttacggtaccgtttaacgttaaccggaacccggttaccgggtacggggggtaacccgg

SEQ ID NO: 272610 - DNA, 739 bp, Homo sapiens
  misc_feature: GYAE6OF02G29YO.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggtttccttgttactatttcaaaaggtgtccagtgtgaggtgcagctggtggagactggaggagacttgatccaaccgtgggggtccctgagactctcctgtgcggtctctggttcaccgtcactactaactccatgagcgtcgggtccgccgaggctccgaggggaacggggcgtgggaggtgggtctctagttatttataggtggtggtggtgcgtagtattacgcagacttccggtaggaacgggtccgagttccaccgtatcctaccgaagaacgaactaaacttccaacttacgaaaccgtaccggtaccttaggttaacttacctttaacgtaaaaacgttcgaaaaccgtaccgtcccgtaagggaacggaaccgggaccccggtaaaccgaacccggtaacccggggttacccgttaccgttttaaacgttaaccgttacgggttacgggaccggggtaaccggggtaaggggttacccggggaaccggggggaacggggtacgggggacccgtaagggttacgggttaacgttttaaaccggtttcccgggaaccggttaccggggtacggggggggtaacccgg

SEQ ID NO: 272611 - DNA, 657 bp, Homo sapiens
  misc_feature: GYAE6OF02F7ADK.21.76.G10.1.454.CMB.1.raw
  modified_base (445)..(445): a, c, t, g, unknown or other
  misc_feature (445)..(445): n is a, c, g, or t
  modified_base (508)..(508): a, c, t, g, unknown or other
  misc_feature (508)..(508): n is a, c, g, or t
tcagtcgtcgctcgcacgaccggtgctcgatttagtcactcatacagggggctgggagaggagcccagcactgggattccgaggtgtttccattcggtgatcagcactgaacacagaggactcaccatggagtttggctgagctgggttttccttgttactatttcaaaggtgtccagtgtgaggtgcagctggtggagactggaggagtacttgatccaacgtgggggtccctaggacgacgtctcctgtcggcggtctcgtgggtccaccgtcactactaactccaagtgagcgtcgggtcccgcccgagggtcctccggagggggaacggggtcgtagggaggtggggtctcgtagtttattagtaggtgggtcggtggtgcagtattacggcgtaggaccgtcggtaggaacgggtccgattccgaacctagtcctacganaagacttaacttccgaagttcaacgtaacgtctaggttaacttcgtaactaaagtccgaaacncgtacgtacgaagtaccggcccgtaacgacgtaccggtccgtattagttaccgtggtacgaccgaggggtacggtcgggaacggggacggggtacgacgtaaggtacggacgtttaccgttacggacccggtagggtgggggtaacccg

SEQ ID NO: 272612 - DNA, 615 bp, Homo sapiens
  misc_feature: GYAE6OF02GHJLB.21.76.G10.1.454.CMB.1.raw
  modified_base (283)..(283): a, c, t, g, unknown or other
  misc_feature (283)..(283): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagtcgtcgctcgcacgaccggtgctcgatttagtcactcatacagggcgtgggagaggagcccagcactgggattccgaggtgttccattcggtgatcagcactgaacacagaggactcaccatggagtttggctgagctgggttttccttgttactatttcaaaggtgtccagtgtgaggtgcagctggtgagacgtgggaggagacttgataccgaaccgtgggggggtcccctaggacgacgttctccgtggtcgcggtcctagtcgggttcaccgtnactactaactccatgacgctgggtcccgcaggctccaggggacgggctggagtcgggtctcagtttattgtaggtggtggtgncgtagntcgnaggctcggagagggcccattccaacatcctaccgtagacgactaactcgtacagaactacgctacgtatcgttaacaaagttcaaacgtcgtacctagaacggacgtacccgtaaccgacggtaaccgcccgtactacgttaacgtcgtcggacgtacggggaagtcggaacggggtacgggaacggtgaaggtcgggttaactaccggtttacggaaccgtacgggcgggggttaacg

SEQ ID NO: 272613 - DNA, 609 bp, Homo sapiens
  misc_feature: GYAE6OF02H7O8J.21.76.G10.1.454.CMB.1.raw
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (435)..(435): a, c, t, g, unknown or other
  misc_feature (435)..(435): n is a, c, g, or t
  modified_base (462)..(462): a, c, t, g, unknown or other
  misc_feature (462)..(462): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaggtgtccagtgtgaggtgcagctggtggagactggaggagacttgatccaaccgtggggggtcctgagactctcctgtgcggtctcgtgggttcaccgtcactactaactccatgacgcgtgggccnccaggcctccgagggaagggctgggagtgggtactnagttatttanaggtgggtggtcggtgcaagtacttacggcaagtactccggtagacgggcctaattccgaccatctaccgagagactaatccatacgaacacncgtagtacttcttaacaaatcgaaacncgacctagacgacgacccgtaacgaaccgccggccgttacctaattaccgtgtacgaccggtacggggtagtcgggaacgggagggaacggacgtacgtagggtaaccttacggtttacggaaccctacgggttacgggggacccgg

SEQ ID NO: 272614 - DNA, 599 bp, Homo sapiens
  misc_feature: GYAE6OF02H1HSI.21.76.G10.1.454.CMB.1.raw
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
  modified_base (509)..(509): a, c, t, g, unknown or other
  misc_feature (509)..(509): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccaaccgtggggggtccctgagactctcctgtgcggtctcgtgggttcaccgtcactactaactccatgagctgggtccnccaggctccgaggggaaggggctggagtgggtctcgagttatttagtagtggtggtgatgcagtattacgnagactccgtagaacgggctatcaactatctccaagagaactaacttccatacgaacncgtntacgtaacttcgttaacaaagtgaaacncgtcctaggacgacgcccggaacgaccgaccgggcccgtacaactttacgngtacggaccggacgggtaggtcgggaaccgggggtaggaacgggctaaggtcggaactttacggtttacgaccgttacgggtacgggggg

SEQ ID NO: 272615 - DNA, 681 bp, Homo sapiens
  misc_feature: GYAE6OF02H5S2M.21.76.G10.1.454.CMB.1.raw
  modified_base (336)..(336): a, c, t, g, unknown or other
  misc_feature (336)..(336): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctgggtggagacgtgggaggagacttgatccgaaccgtggggggtccctgagactcctctgtgcggtctcgtggttccaccgtcactactaactccatgagcgtcgggtcccgcgacggcctccggaggggaacgggcgtagggnggtcgggtctcgtagtttatttagtagtgggtggtggtgacgtagtacgttacgcgtacgacgttccggaggacggggtacccgtattcccgaacctacttcctaccgaaggaacgtaacctaaactttcccaagttacgaaacgaccgtacttagttaacttacgtttaacaaacgttcgaaaccgtacgcccttaagacggaccggaccgaaccgtaacgcccggtaccttacgttattaccgtgtcgacgggtacggggaggtcggggaaccgggggaggtacgggacgtacggtggttaaccttacggttaccggaaccgtcgggtacggggtaacccggg

SEQ ID NO: 272616 - DNA, 648 bp, Homo sapiens
  misc_feature: GYAE6OF02FZL76.21.76.G10.1.454.CMB.1.raw
tcagtcgtcgctcgcacgaccggtgctcgatttagtcactcatacagggggctgggagaggagcccagcactgggattccgaggtgtttccattcggtgatcagcactgaacacagaggactcaccatggagttttggctgagctgggttttccttgttactattcaaagtgtcagtgtgaggtgcagctggtggagactggaggagacttgactccaaaccgtggggggtccctggagacctctccgtgtcggcggtctctgggtcaccgtcactactaactccagtcgagcgtggtccgcaggctccgagggagggctggaggtggtctcgagttattagtaggtggtggtggtgacgaggtagttaccgagtaacgacgttccggtagggaaacgggccgttaattcccaaccgtatccgttaccgaaggacgtaactaaacgttcccaattacgaacgtaccgtcgtagtacttactaactaaagtcgaaactcggacctggaacgacggacccgtaccgaacgtacccggcttaacttacgttactaggcggtacggaaggggtaggtacgggacggggtaagggacgggtacctaggtaggtaactttacggttacggacccggtacggcgggggtaacccg

SEQ ID NO: 272617 - DNA, 702 bp, Homo sapiens
  misc_feature: GYAE6OF02J15QR.21.76.G10.1.454.CMB.1.raw
  modified_base (302)..(302): a, c, t, g, unknown or other
  misc_feature (302)..(302): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacgtcgggggtccctgagactctcctgtcgcggtctcgtgggttccaccgtcgacctactaacctccatgagctgggtcccnccagcgtccgagggaagggcgtggaggtggtctcgtagttagtttagtacgtggtcgggtaggtggcgagtacttacgacagtaccgtccggtaggtaaacgggggtccctaacgttcccaaccgtacgtacccgtacccgtaagacgtaaaccgtaaacttccccgaagttaacggaaacctacggtaccttaggtacttaccttacgaaaacgttcgaaactaacgtccgtaaggacgacggtacccggaaccgaaccggtaccggtaacccggtttcttaaacgttaccgtggtcgtacccgggagggtacggtacggggacggggaacggggtacggacgaagtacgggttaactaccggtttacgaaccccggttgggtacggggtaaccccggg

SEQ ID NO: 272618 - DNA, 649 bp, Homo sapiens
  misc_feature: GYAE6OF02GF1UW.21.76.G10.1.454.CMB.1.raw
  modified_base (269)..(269): a, c, t, g, unknown or other
  misc_feature (269)..(269): n is a, c, g, or t
  modified_base (514)..(514): a, c, t, g, unknown or other
  misc_feature (514)..(514): n is a, c, g, or t
tcagtcgtcgctcgcacgaccggtgctcgatttagtcactcatacagggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagacgtggaggagacttgatccaacgtgggggtccctgagactctcctgtgcggtctcgtgggttcaccgtnactactaactccatgagcgtgggtccgccaggccgtaccgaagggggtaacggggctagggaggttggggtcctcgtaaggtttatttagtacggtggtagggttggtgacaggtattaccgggctaggtacctcggtaggaaacggggcctaacgttcaaccctaagttccaccgaagtacgactaaacttcccgaattacggaaaccaccgtcgttagttacttcctttaacaaatcgaaacnggtccctaggaagacggcccgaacggtacaccgggtccgttactaacgttacgtggacggacgacggggtaaggtcgggaacggggacggacgggacaggtcggacttacgttagacccggtaggcggggtaacg

SEQ ID NO: 272619 - DNA, 708 bp, Homo sapiens
  misc_feature: GYAE6OF02H4FUT.21.76.G10.1.454.CMB.1.raw
  modified_base (504)..(504): a, c, t, g, unknown or other
  misc_feature (504)..(504): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttacaaaaggtgtccagtgtgaggtgcagctggtggagacgtgggaggagacttgatccaaccgtgggggtccctgacgactctctgtgcggtctcgtggttcaccgtcactactactcatgagcgtggtccgcgacggcctacggaggggaacgggcgtgggaggtgggtctgtagtttatttagtaggttgggtggtggtgactaggtaacttacggactagtaaccgtccggtagggtaacgggccgtacttaccgaaccctatacctaccggagtaaacggtacctaaattccccgaaagttccgaaacctacggtcttaggtaacttccgttaaanaaacgttgaacccaggtacgacgggtaaacgccggtacccgaaccggaaccgtaccgggtaccgtttacttaacggtttaccgagggtcggacccgggaaagggggtcgtaacgggggacgggggaagggtaccgggatacggttacgggttaacgtttaaccctttacgggggaacccgtacgggggttccgggggaacccgg

SEQ ID NO: 272620 - DNA, 570 bp, Homo sapiens
  misc_feature: GYAE6OF02GZG8A.21.76.G10.1.454.CMB.1.raw
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggtttccttgttactatttcaaaaggtgtccagtgtgaggtgcagctggtggagactggaggagacttgatccgaaccgtgggggtccctgagactctcctgtgcgtctctggtcaccgtcactactaacctccatgagctcgggtccgccaggcctccgaggggagggcgaggaggtggtctcgagttattagtaggtggtggtggngcagattacgnagactcggagaacgggcgattcaccatcacaganactaatccagcaacncgctgtacttactacaaatcgaaactgcctagacgacgcccgaagaccgaacgggtccttaactagtacgtgtcgacgggtaagggtacggtcgggaaccgggtagggacgggtacaggtggttacgtaccgttagaccgtacgggtacggggacgg

SEQ ID NO: 272621 - DNA, 702 bp, Homo sapiens
  misc_feature: GYAE6OF02JXVWU.21.76.G10.1.454.CMB.1.raw
  modified_base (317)..(317): a, c, t, g, unknown or other
  misc_feature (317)..(317): n is a, c, g, or t
  modified_base (608)..(608): a, c, t, g, unknown or other
  misc_feature (608)..(608): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttacaaaggtgtccagtgtgaggtgcagcgtggtggagagtgggaggagtacgttgatcccgaaccggtcggggggtcccctggacgactctccgtgtggcggtctcgttacggttccaccgtcgacttactaactccatgagcgtcggtccncgcgcctccgagggacggtcgtggaggtcggtcctagttagtttagtttacgtaggtgggtgggtggtcgaccgtaaggttacgtacgtacgtaacgtaccggtcggtacgggaacgggtcccgtacgttacccgaccgtacgttcccgacggaaggactttaacccctaaaggttccccaaaagtcggaaaccttcggtcgttacgtattcgttaacctaaaagtcccgaacgtaccgtccgtagaccgtacgggacccacgggtacctaccggtccttaactagttcgnggtccgacggggtacgtagggtacgggtacggggaggtacgcggttagtcggttaacgttacgtcccggaaccggttcggggaggggtaacccg

SEQ ID NO: 272622 - DNA, 622 bp, Homo sapiens
  misc_feature: GYAE6OF02I03KD.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgtactattcaaaaggtgtccagtgtgaggtgcagctggtggagactggaggagacttgatccaactggggggtccctggagactctcctgtgcggtctctgggttcaccgtcactactaactccatgagcgtgggtcccgccaggctccagggaaggggctgggagtggggtctcgaggtttattacgtagtgggtggtggtgcgagattacgcagtaccgtcgtaggaagggccgtattaccaccgtatcctaccgagaagaacaacttacatagaacacctcgttagtaagttctttacaaaacttcgaaactacgaccttggtacgaacgtcccgaacgtaccgaaccgggtacccgttactactttaaccgttacggtacgacggaaccgggaggtgggaaccggggagggaacgggacgacgttggaacgttcgtttacggaccgtacggtgggggtacccg

SEQ ID NO: 272623 - DNA, 761 bp, Homo sapiens
  misc_feature: GYAE6OF02JBLHN.21.76.G10.1.454.CMB.1.raw
  modified_base (412)..(412): a, c, t, g, unknown or other
  misc_feature (412)..(412): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcaggcgtggtggagacgtgggaggagacttgaactccgaaccggtcggggggtccctggacgactcctcctgtgcgtctcgtggttcaccgtcactactaactcctatgagcgtcgggtcccgaccgaggccgtaccggagggggaagggtccgtagggaggtcgggtctcgttaagtttattttagtaggttgggtgggtgggtgcgtaagtacgttaccgngtaacgtaccgtccggtagggaacggggtcccgtaacgtttcccgaacctacgttcccgtaccgaaagacgaaacctaaacgttacccaagttaacgaaacccgtaccgtccgtagttaccttacttaactaaacgtagaaacccagacccgtaggaaacgggaccgacccggaacggacccgtaaccgggcccgtttaactaacgtttaacggtcgggttaccgacggggtaaccggggtagggtacgggggaaccgggggtaagggtacggggaccttaacgggtagggttaacctttaccgggtttaccggaaccgggttaccgggggttaggggggtaaccccgg

SEQ ID NO: 272624 - DNA, 766 bp, Homo sapiens
  misc_feature: GYAE6OF02H728M.21.76.G10.1.454.CMB.1.raw
  modified_base (286)..(286): a, c, t, g, unknown or other
  misc_feature (286)..(286): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtgggggtccctgacgactctctgtgcggtctcgtgggttccacgtcactactaactcatgancgtcggtccactacggcctcggaagggaacgggctagggagtgggtctacgtagttattagtaggtggaggtcggtgacgtagtaactacggactaacgtactccgggtagaacgggacctagttacccaacctacttccgtaccgaaggaaccgtaaacgtaacttacccaagtacgtaaaccgacgtacgttacggttaactaccgtttaaacgaaaacttcgaaaaccgtcggtaaccccgtagggaaaccggtaacgggacccccgtaaacgggtaaacccgtaacccgggtaacccggtttaacctttaaacggtttaacccgtagggtaaccgggtaaccggggtaacccgggggttaaggtaaccgggggtaaaccggggggaacgggtaccggggtacgtaaggttacgggttaaacctttaccggtttaaccggaacccgtttaaccggggtaccgggggggttaacccgg

SEQ ID NO: 272625 - DNA, 688 bp, Homo sapiens
  misc_feature: GYAE6OF02IG9CG.21.76.G10.1.454.CMB.1.raw
  modified_base (170)..(170): a, c, t, g, unknown or other
  misc_feature (170)..(170): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (380)..(380): a, c, t, g, unknown or other
  misc_feature (380)..(380): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttcttgtactatttcaaagtntcagtgtgaggtgcagcgtggtggagactggagagacttgatccgaacgtcgggggtccctgacgactctcctcgngcggttcngttcggtcaccgtcactacctactccatgactcggtcggccgcgacggccgtaccggaggggtaacgggcgtaggaggtcgggtctacgtagtttacgtttagtaggttagggttggtgggtacgngtaagtactttacggactaacggtaccgttccggaaggtaaccgggtcctaacgtacccgacgtacttaccgtaccgaacgtaacgaccgtaacttaccgacgtacgtaaaccgtacgtacttaccgtaacgttacttacaaagtcgaaacctgtaccgtcgaacgtaccggacccgtaacgtaccgacccggtcccgttaagttacgttaaccgtaggttccggaggtccggggtaagtcggggaacggggtaggcgggtagtaccggtagtacgttacgttacggaccgtacgggtgggacccggg

SEQ ID NO: 272626 - DNA, 669 bp, Homo sapiens
  misc_feature: GYAE6OF02GEJQG.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaaccgtggggggtccctgacgactctcctgtgcggtctctgggtcaccgtcactactactccatgacgcgtcggtccgccgaggcctaccggaaggggacggggtcgtagggaggtcgggtcctagtagtttagtttagtaggttggttggtggtgacgtagagttaccgcagactccggtggaacgggccgtattcccaaccataccgtccgaagtacgaactaacgttaccatacgaaccacgtctagtacttactactaaagtacgaacacgacctagaacggacgacccgaacgaacccggtaccggtaccgttacgttaacgttacctacgggttcgaccgggtaacggggtacggtaacgggtacgggggaagggtacggggacgtacggtagggtaaacgtttacccggttacggacccgtacgggtacggggggtaacccgg

SEQ ID NO: 272627 - DNA, 766 bp, Homo sapiens
  misc_feature: GYAE6OF02GQEDG.21.76.G10.1.454.CMB.1.raw
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcttgggttttccttgttactatttcaaaaggtgtccagtgtgaggtgcagctgggtgagacgtgggaggagacgttgactacccgaaccggttcgggggggtacccctaggacgtactctcctggtgcggtctcgtcggtcaccgtcactactaactccatgagcgtcgggtcccnccgaggcctaccggaagggaacggggcgtgggaggtcgggtctgtaagtttatttaagtaggttgggttgggtggtgcgtaggtaacgttaccgngaacggtaccgtaccggtaggggaaaccgggtccggtaacttacccaacccgtaaccgttaccgtaccccgtaaggaaacccgttactaaaccgttcccaaactcgggaaacccaaacggttccgttaggttaacctttaccttaaacgaaaacttacgaaacctacggtcccgttaaggaacggaccgaacccggtaacgaacccggaccgggttaccgtacttacgttaacgtcgttacggacgggtacggggtacggtaacggggaacgggggtacgggacgggtagtaacgggtacggttaacgttacccggtttacggaacccggtaggggtaccggggggaacccgg

SEQ ID NO: 272628 - DNA, 680 bp, Homo sapiens
  misc_feature: GYAE6OF02F9O23.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgactaccaaccgtcggggggtccctggacgactctcctgtgcgtctcgtggtcaccgtcactactaactccatgagcgtcgggtccgccaggcctaccggaggggaacggggctagggaggtcgggtctacgtagttatttaataggtgggtggtggtgacgagtatacgacagtacgttcggaggaacgggcctataccacctatcctaccgaagacgaactaacttaccaatacgaaaccacgtctagttaacgttctaactaaatcgaaactagcccgttaggacgtaccggacccggaacgaaccgtacccgggtaccgttaacttaacgttaacgtacggtcggaaccggaacgggggtaaggtacgggggaacgggggaacggggacggggtactaagggttaacggtacgtttaacgtttaaccgggaacccggttacgggtcggggggtaaacccggg

SEQ ID NO: 272629 - DNA, 768 bp, Homo sapiens
  misc_feature: GYAE6OF02ILXVH.21.76.G10.1.454.CMB.1.raw
  modified_base (290)..(290): a, c, t, g, unknown or other
  misc_feature (290)..(290): n is a, c, g, or t
  modified_base (354)..(354): a, c, t, g, unknown or other
  misc_feature (354)..(354): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttacaaaaggtgtccagtgtgaggtgcagctggtggagacgtgggaggagacttgaactcccgaaaccggttgggggtccctgagacctctcctgtgccggtctcgtggtcaccgtcactactaacnccatgacgcgttacgggtccccgccgacggtccgtccggaaggggaaggggccgtgggtacggnggttactccgtagtttaacgttttagtaggtggggttggttgggtggacgtagtacgttacgacgaacgtacgtaccggtggaaaccggtcctaagttcccgaactcgttccgtaccgtaagaacgtaactaacgttcccaaagtacaaacgtcgtcttacggttactacgtttaacgaaacgtacgtaaacctacggccgttaacggaaccgggaccgtaaaccccgaaacggtaccccggtaacccgggtacccgtttaaccttaacggttaaccgttagggttaccgggaccgggtaaccgggggttcgaaccgggggtaacggggtaacggggacgggtaaccgtagggttaccgggttaacggtttccggttaaccgaccgggtaccgggtacccggggggtaaaccgg

SEQ ID NO: 272630 - DNA, 708 bp, Homo sapiens
  misc_feature: GYAE6OF02H5I0A.21.76.G10.1.454.CMB.1.raw
  modified_base (175)..(175): a, c, t, g, unknown or other
  misc_feature (175)..(175): n is a, c, g, or t
  modified_base (317)..(317): a, c, t, g, unknown or other
  misc_feature (317)..(317): n is a, c, g, or t
  modified_base (655)..(655): a, c, t, g, unknown or other
  misc_feature (655)..(655): n is a, c, g, or t
  modified_base (696)..(696): a, c, t, g, unknown or other
  misc_feature (696)..(696): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggtagtttggctgagtctgggttttccttgttactatttcaaaaggtntccagtgtgaggtgcagcgtggtggagacgtgggaggacgtacttgactccgaaccggtcggggggtccctggacgaccttcctccgtggtcggtccggtcttcggttcgggttccaccggtcctaactaccttaacctccntagacgtcgtcgggtcccgccgacccggtaccgtccggaaggggaccgggacgtggtacggtcgggtctacgtagttacgttagtagtgggtaggtggtggctagtattacggtacacgtaccgtacggtacgggtaacggtcgtactaccgtacctagtccctacgaacgtacggtaacctaataccccaagtaccgaaaccgtaccgtctttagaactttccgttaaacaaggtaccaaacgtctaaccgtggaacgtaccgacccgaaccgtacggtacccgtacgttactatcgttacggtcggtacggacgggtagcgggaacgggtacgggngtacgtacgtagtaaccttacggttaccgacggtaccgggngggtaaccccgg

SEQ ID NO: 272631 - DNA, 641 bp, Homo sapiens
  misc_feature: GYAE6OF02IAZJ1.21.76.G10.1.454.CMB.1.raw
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (545)..(545): a, c, t, g, unknown or other
  misc_feature (545)..(545): n is a, c, g, or t
tcagtcgtcgctcgcacgaccggtgctcgatttagtcactcatacaggggctgggagaggagcccagcactgggattccgaggtgtttccattcggtgatcagcactgaacacaggaggactcaccatggagttttggctgagcttgggttttccttgttactatttcaaaaggtgtccagtgtagaggtgcagcgtggtggaggacgtgggaggagtacttgactacccgaaccggttcggggggtccctgacgactcctctgtgcggtctcgtggtcaccgtcactactactccatgagngtcggccncgacgcgtaccgaggggaggngtggnggtggtctntagttattagtgtggtggtgtgcgtagtagtagacagactacggtaggaacgtcgtacgtacacctacgtctacccgagtaacgtaaacctacttccaaagtacgaaaccaccgtacgttagttaccttacgttaactaagaacgtaacacgaccgtagtagaacggcgaaccggacgaaccggttcttacgtagttacnggtacgtacggacgggtaggcgggtaacgggaggggacggacgtaagtcggtaagttaccggttacggacccggtaccggggtagggtaacccggg

SEQ ID NO: 272632 - DNA, 867 bp, Homo sapiens
  misc_feature: GYAE6OF02G0RPU.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagtttgctgagctggtttcttgttactattacaaaggtgtcagtgtgaggtgcagctggtggaggagtgggaggagtactttgacgtaccgtaacccggttcggggggttcccctgtacggaccttccgttcctggtcggtccggttcgttcggttcgggttccaacccgtctaacctacgtaaccttccatgacgcggttcgggtcccgccgacggtcctaccggaacggggtaacggggcgtagggtacggttgggttctccgtagtttagtttagtaggtttgggtggttggtggtacgtagtacgttacgcgtaacgtaccgtcggtaagggtaacgggtacgtacttaccgaaccttagtccccgtaccggaaagtaaacccgtactaaccgtttaccgaaaacgttcgtaaaacccgcggtaccttaacggtttaactccttttaaaccgaaaacgtttacggaaaccgtaacgtcccggttaagaacggtaaccggaccccggtaaagaaccccgtaaccggggttaaccccttcggttaaactttttaacccgtcggggttaacccgggacgggggtaaccggggtttaaaccgggtggggggtaaaccccggggtacggggggtaacccggtaacggggtttaaggtttaaccgggttaccgggtttaaacccgtttaacggggtacccccccggggaaagggggttccgggggggtaaaaccccgggg

SEQ ID NO: 272633 - DNA, 747 bp, Homo sapiens
  misc_feature: GYAE6OF02HM5J6.21.76.G10.1.454.CMB.1.raw
  modified_base (668)..(668): a, c, t, g, unknown or other
  misc_feature (668)..(668): n is a, c, g, or t
tcagtcgtcgctcgcacgaccggtgctcgatttagtcactcatacagggctgggagaggagcccagcactgggattccgaggtgtttccattcggtgatcagcactgaacacagaggactcaccatggagtttgctgagctggtttcttgttactattacaaaggtgtccagtgtcgaggtgcagcgtggtggagacgtggaggagacttgataccgtaaccgtcgggggtccctggacgtactcgtccgtgtcggtacggtcctcggttcggttccaccggtctaccgtactaacgtaccgtatacggtcgtcgtcgggtcccgccgaacggtcctaccgggaagggacgggtcctacggggaaggttcggtaccgtttagaacggtttttagttaccggtaaggtccggggttagggtcggttcgacggttaaacggtaccggtttaaccgacgtaaacggtacccggttttacgggaccgggtaaaacgggggttacccctagttttacccgaaaccgtacggttaccctaccggtaacgggttaacaaccgttaacgttcccgaagttaaccgtaaacgacggttcctaagtcttaaccgtataagacaacgagtcgtacgagacgtacccgaacgcgtaccgtacgtctacgtacgtggtacncggaacggtagccgggtaaggcggacggtacggagttacgggaccttaaggtacccgtacggtacggtcgggtaaccgg

SEQ ID NO: 272634 - DNA, 668 bp, Homo sapiens
  misc_feature: GYAE6OF02G1FE8.21.76.G10.1.454.CMB.1.raw
  modified_base (473)..(473): a, c, t, g, unknown or other
  misc_feature (473)..(473): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagcgtgggttttccttgttactatttcaaaaggtgtccagtgtgaggtgcagctggtggagacgtggaggagacttgatccaaccggtcgggggtccctggacgacctcctccgtgtcgcggtcgtcgttggttccaccgtcactaacgtaacctccaatggacgcgtcgggtccgccgacgggcctaccggaggggaacggggcgtgggaggtcgggtctgtagtttagtttagtacggttggtgggtgtgtcgaagtacttacacgacgcgtacggaggaacgggtctaatccgactctctaccgaagtacgaactactcaattacgaacnccgtatcgtattcgttaaacaagtacgaactacgtcgagacgacggcccaacggaccgtccggtaccttattaaacgttcgtacgtcgggaccgggtaagggtaggtcgggtaacgggggaggtaacggtacgagggttaacggttacgttaacccgttaccgggaaccggttaccggggtacggggtaacccgg

SEQ ID NO: 272635 - DNA, 863 bp, Homo sapiens
  misc_feature: GYAE6OF02I1IXQ.21.76.G10.1.454.CMB.1.raw
  modified_base (725)..(725): a, c, t, g, unknown or other
  misc_feature (725)..(725): n is a, c, g, or t
tcagtcgtcgctcgcacgaccggtgctcgatttagtcactcatacaggggctgggagaggagcccagcactgggattccgaggtgttccgattcggtgatcaagcactgaaaccacagaggactcaccagtggacgttttgctagagctttgggttttccttagttacctagttttacgaaaggttcgtacctagtgtacggagtgcaggaccgttgggtaggtacaccgtgggaaggtatacgttgacctaccgtaccgggtcgggtcctagaacgtcttccgtcgtgtcgaccgttcgtgtcggtctaccgtctacgtactaacacagtacgagtccggtacggtccccgacgtaacgggtccgtaagggaacgggggtaacgggtcgtacgggtagggttcggtcctagtttaaggtttaacgtttagtcgggttagggttacgggtaggttagtacggtaacggtaattacccggtacgtaccggtaacggttaacggtaccggggtaacggtaccccttaacggttaccaaaaccccgttacgttaccgaaccgtaacgtaaacggtaaaccctacgtaacgtaactacgaaacccggtaacctcgtaacgtttacttacgtaaaaccgtaacgtacgtaaaccgcttaaaccgtggaaacccgttacccggaaaccgtaacgacggttacccccgacgtttaaaccttacgggttaccngggtaacccgtaacgggggtccggtaaacggtcggggtaaaggggtcccgggtaaggacccgttaaggggtaacccggttaacgttttaaaccccggttcggggaaacccgtttacgggggccgggaaacccccgggg

SEQ ID NO: 272636 - DNA, 598 bp, Homo sapiens
  misc_feature: GYAE6OF02JJ8XV.21.76.G10.1.454.CMB.1.raw
  modified_base (195)..(195): a, c, t, g, unknown or other
  misc_feature (195)..(195): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (383)..(383): a, c, t, g, unknown or other
  misc_feature (383)..(383): n is a, c, g, or t
  modified_base (428)..(428): a, c, t, g, unknown or other
  misc_feature (428)..(428): n is a, c, g, or t
  modified_base (446)..(446): a, c, t, g, unknown or other
  misc_feature (446)..(446): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
  modified_base (565)..(565): a, c, t, g, unknown or other
  misc_feature (565)..(565): n is a, c, g, or t
  modified_base (577)..(577): a, c, t, g, unknown or other
  misc_feature (577)..(577): n is a, c, g, or t
tcagtcgtcgctcgcacgaccggtgctcgatttagtcactcatacaggggtcgtgggagaggagcccagcactgggattccgaggtgtttccattcggtgatcagcgactgaacacagaggactcaccagtggagttttggctggagtcgttggtttaccgttgttaacgtactttcaaaaggtgtccagtgtgnggtgcagcgtggtggacgagtgggagagtagttcgagtcccaacggttcgggggtcccttgggacgacctactcctggtcgcgtcgtcgtcgttccgacgtccactacaactccgatccgagtcgcggtccncgngctaccggaggacggcgtggagtgggtctgtagttatagtggtggtggttggncgtagtactacgtcgagtacgtcgaggaaccggcctagtaccacncgtcacacgacattaacnctatcgaagcctctagtctacgttanaagtacgaacgtancccgaagaagcgttaccgaaccggaccgcgggtaaactcgttagtcgtaggaccgtggactaggtcgggaagtggacgngtaagtcgtaangttacgccgtggccggaacgg

SEQ ID NO: 272637 - DNA, 731 bp, Homo sapiens
  misc_feature: GYAE6OF02JE1FU.21.76.G10.1.454.CMB.1.raw
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (401)..(401): a, c, t, g, unknown or other
  misc_feature (401)..(401): n is a, c, g, or t
tcagtcgtcgctcgcacgaccggtgctcgatttagtcactcatacaggggctgggagaggagcccagcactgggattccgagtgtttccattcggtgatcagcactgaacacagaggactcaccatggagttttggctgagctgggtttccttgttactatttcaaaaggtgtccagtgtgaggtgcagcgtggtggagactgggaggagactttgactccaaccgtggggggtcccctgagtactctcctgtcgcggtctcgtcggttcaccgttcgactactaactccatcgnacgtcggtaccnccaggctccgaggggaacgggtcgtagggaggttcgggctcgtagtttagtttaagtggtcggtggggttggtcggacgtaagtagtttaccgnaacggtacctccggtaaggtaccgggtccgacttaccgacctactccgtaccgtaacgggtacaaccgttaactttccgaaggtacaaacccgaggtatttacgaagttccttacaaaagtgaaccgtagtccccggtagaggtacccgggtaaccgaaccggtcgggaacccgttacccggtttataaaccgtttagcgggttaaccggtacggaacgggggttaccgtaacggggggaacgggaaccgggtgggtaaccttaagggttaccggaacctttttaccggttacgtaaacccccggttagggggtccggggtaaaccccgg

SEQ ID NO: 272638 - DNA, 727 bp, Homo sapiens
  misc_feature: GYAE6OF02HWHOZ.21.76.G10.1.454.CMB.1.raw
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
tcagtcgtcgctcgcacgaccggtgctcgatttagtcactcatacaggggctgggagaggagcccagcactgggattccgaggtgtttccatttggtgatcagcactgaacacagaggactcaccatggagtttggctgagctgggttttccttgttactattcaaaaggtgtccagtgtgaggtgcagctggtggagacgtggaggagacttgatccaacgtcgggggtccctgagactctcctgtgcggtctcgtggttcaccgtcactactacncatgagctgggtccncgagcctcggaaggggaggggctgggacgtgggtctcgtagtttagtttagtggttagggtggtggtagcgtagtagttaccgcgtacgtaccgtccggtagggaacggggtccctaagtttcccaaaccgtacttaccccgtacgaacggtaagaacccttaacttaccaagttacgaaacccgtcgtaccgtttattaaccgttactttaaacgaaacgtacgaaccgtacggtacccgtaagggaccgtaacggaccccggaacgtaacccggaacccgggttcccgttaactttaacggttaacgtgggtaccggtaccgggacggggttacggtaacggggaacccggggggttaggaccggggttactaacgggttggtaacgtttaccggttaaccgggccggtaaccgggggttggggaaacccggg

SEQ ID NO: 272639 - DNA, 925 bp, Homo sapiens
  misc_feature: GYAE6OF02FLI4Q.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcgttgggttttccttgttactatttacaaaaggtgtccagtgtggaggtgcagcgtggtggagacgtagggaggagtacgttgacttacccgaaccggttcgggggtcccctaggacgtaccttccgtccgttggtcggtccggttccgttccggttcgggttacccgtacccggttacctaacccgttaacctaaacccttaccgacgttacggaacggtccggttccgggggtcccccgaccggtacgggcccggttacccgggaacggggggtaacgggggtccgttacgggggtacggggtttcggggttacccgtttaccggtttaaaggtttttaacggttttaaggtttaggggtttgggggttacggggttggggttaccggtaacccggtaaggtttaaaccgtttaaccggtacgtaaccggtacccggttcccgggtaacgggtaacccggggtacccgttaacgttacccgaacccgtaacgttcccgtaaccgtaaagggaaccgttaaccttaacgttaccgaagtaccgaaacccgtacgtctaacgttacttacgtaaacaacggtacaacgtcggtacctggaacggcccggaacccgaacgtcccgtacggttccgttaaccttacgttaccgtgggtaccggaccggggtagggtacgggtacggggaaccggggtaggggtaacccggtacggtaggttacgggttaaccgtttaggttaccccggaacccggggtttagggtacccgggggtaaaccccgg

SEQ ID NO: 272640 - DNA, 910 bp, Homo sapiens
  misc_feature: GYAE6OF02HJ4WY.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggtagttttggctgagctgggttttccttgttactatttcaaaaggtgtccagtgtgaggtgcgagcgtggtggagtacgtgggaggagtacgttgacgtacccgtaacccggttcgggggggttcccctaggacgaccgttcctaccgttggtcggtccgggttccgttccgttcggggtttaccgtacccggttaccaaccgttaaccgttaaaccgtcctaagtcgacggtccggttacggggtcccggaccgaacgggtcccgttaccggaagggggtaacggggtcgttacggggtaggttcgggttacttacggttaaggttttaagttttaggttaacgggttgggttcgggttcggtacggtaccgtaagttaacgtttaaccggactaacggtaaccgttccggtacgggtaaaccgggtacccgtaacgtttacccgaaccgtaccgttaccgtaacccgaaaggtaacggaaaccctttaacgtttacccgaaagttacggaaaccggttaccgtcgttaacgttaacttacccgttttaacaaaacggtttaccgaaaacctacggtcccgtaaggacgggtaaacctacccgggaaaccgtaccgggtaaacccggttcccgtttaactttaacgtacccgttgggtaccggaccgggaacgggttacgggacgggtaacgggggtaacgggacggtaccgttaaaggttccggttaacgtttaacccggttaccggtaacccgggttaccggggtacggggtaacccgg

SEQ ID NO: 272641 - DNA, 666 bp, Homo sapiens
  misc_feature: GYAE6OF02I9U2I.21.76.G10.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagtcactcatacaggggctgggagaggagcccagcactgggattccgaggtgtttccattcggtgatcagcactgaacacagaggactcaccatggagttttggctgagtcttgggttttccttgttactatttacgaaaagtgtccagtgtgaggtgcagctggtggagacgtgggaggaagtacttgactcccaaccggtcggggggtacccttaggacgacctcttccgtggtcggtcgtcctcgttgggtcaccgtcactaacctaactcatgagtcgtcgggtccnctaacgggccttaccgagggggaacgggcgtgggacggtggtactgtaactttagtttacgtaggtggtgggtggtagacgtaggtaacttacggcgaacgtaccgtccggtaaggtaacgggtcctagtttacccaaccgtacttcctacgaaagaaccggtaacttaacctccgaagtaacgaacgtaaccgtgtacttaacttcttaaccaaattcgaaaactcgtaccgtaggaagtaccgacccggtaagaacccgtcggaccttacgttattacgtagcgacggaggtacgggaacggaggacgactagagtacttacgagccgtggtacgggacg

SEQ ID NO: 272642 - DNA, 677 bp, Homo sapiens
  misc_feature: GYAE6OF02HUPGT.21.76.G10.1.454.CMB.1.raw
tcagtcgtcgctcgcacgaccggtgctcgatttagtcactcatacaggggctgggagaggagcccagcactgggattccgaggtgtttccattcggtgatcagcactgaacacagaggactcaccatggtagttttgctgagtcttgggttttccttgttactatttacgaaaaggttgtcctagtgtaggaggtgcgagcgtgggtagagacgtggaggagtacttgactaccgtaaccggtcgggggtcctagacgtactcgtccgtggtacgcggttacgttcgtacggttaccgaccgttccgtaacgtacctaacgtccagttcgcggtcgtcgggttacccgacgacggtcctaccggagggaacggtgtagggtcgtacgggttctacgtagttagtttaggtggttggtaggtgtgcgtaagtacgtagtcagtaccgtacggaggtaacgggctacgtaccacgtacttccgaccgtagacgtaacgtaactccgaagtaccaacgcgtactgtacttacttacaagtactaacacgtgaggacgtaacgccgaaccgtaccggacgttctacgtacttaacgtcgcggtacggcggtaggagggtaccggaggacggtaccgaggttacgtacgttacggttaccgacggtacggtacgggtaaccg

SEQ ID NO: 272643 - DNA, 522 bp, Homo sapiens
  misc_feature: GYAE6OF01EDTZH.8.87.H10.1.454.CMB.1.raw
  modified_base (428)..(428): a, c, t, g, unknown or other
  misc_feature (428)..(428): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcgggaacacggccaccctgaccatcagcagggcccaacccttggatgaggtgactattctgtcaagtgtgggacaccaacncttgtgtcttcgggactgggaccgaggtcaccgtcctaagtcagcccagggcccaacccactcgcactctcgttccccgccctcctcgcaccgg

SEQ ID NO: 272644 - DNA, 542 bp, Homo sapiens
  misc_feature: GYAE6OF01A1WI7.8.87.H10.1.454.CMB.1.raw
  modified_base (506)..(506): a, c, t, g, unknown or other
  misc_feature (506)..(506): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccgaagtcgggaacacggccaccctgaccatcagcacggcccaaccttggatgaggtgactattctgtcagtgtggacaccaacacttgtcgtcgttcgggactgggaccgtaggtccgaccgtcctaacgtcacgcccgacgggcccaaccccgactcgtaccncttctccgttccccgcccttccctccgacctaccgg

SEQ ID NO: 272645 - DNA, 539 bp, Homo sapiens
  misc_feature: GYAE6OF01A3OAF.8.87.H10.1.454.CMB.1.raw
  modified_base (412)..(412): a, c, t, g, unknown or other
  misc_feature (412)..(412): n is a, c, g, or t
  modified_base (498)..(498): a, c, t, g, unknown or other
  misc_feature (498)..(498): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatcttagcgattccaaccggccctctgggatccctgagcgattctctggctccaagtcgggaacacggccaccctcgaccatcagccacgggcccaacccgttggatgagggtgactatttcngtcagtgtgggaccacaacacttgtgtcgttcgggactgggaccgtaggtcaccgtcctaagtccagcccgagggccccaaccccnctcgtccactcctcgttcccccaccctcccgtcgccaccgg

SEQ ID NO: 272646 - DNA, 542 bp, Homo sapiens
  misc_feature: GYAE6OF01ADIUO.8.87.H10.1.454.CMB.1.raw
  modified_base (504)..(504): a, c, t, g, unknown or other
  misc_feature (504)..(504): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggagagtcaacattgggacttcagatgtgcactggtaccagcagaagccaggccaggcccctgtactggtcatctttagcgacttccaaccggccctcgtgggactccccgtgacgcgattctctggctccgaaggtcgggaacacggccaccctgaccatcagcacggcccaaccttggatgaggtgactatttctgtcaagtgtaggacaccaacacttgtcgtcgtcgggacgtcgggaccgagtccaccgtacctaacgtcacgcccgacgggcccaaccccnctcgtccactcctcgttccccgccctccctcgacaccg

SEQ ID NO: 272647 - DNA, 575 bp, Homo sapiens
  misc_feature: GYAE6OF01BYECN.8.87.H10.1.454.CMB.1.raw
  modified_base (417)..(417): a, c, t, g, unknown or other
  misc_feature (417)..(417): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgtattccaaccggccctctgggactcccgtgagcgattctcgtggctccgaagtcggggaacaccggccacccgtgaccatcgagccgacggcccctaacccgttggacgtggagggtnacgttatttcgtagtcgtaaggtgtacgggaccaccgaactaccgttgtcgtccgttcggggacttcggggacccgtaggtccaccgtctaacgtcacgcccgacgggcccaaccccgactcgtccactctccgttccccaccctcctcgactaccgg

SEQ ID NO: 272648 - DNA, 532 bp, Homo sapiens
  misc_feature: GYAE6OF01B5IPC.8.87.H10.1.454.CMB.1.raw
  modified_base (441)..(441): a, c, t, g, unknown or other
  misc_feature (441)..(441): n is a, c, g, or t
tcagctcgcgtgtccacgaccggtgctcgatttagcagtactgcgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcggccctcagggactcccgtgagcgattctctggctccactctgggaacacacgccactctcgaccagtcacgccgggacccagggcctacgggatcggaggctgtacttattactgtcgaggcggtgggacngcagcactagttggtcgggtttcgggcgggacgggtaccaaggtccgtacggacccgttccgttcggtaccgaggcccgagggcctcccgg

SEQ ID NO: 272649 - DNA, 767 bp, Homo sapiens
  misc_feature: GYAE6OF01DC2ZA.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagtctccttgctcactttacaggttctgtggcctcctatgaactgacacagccactctcagtgtcagtcggccctgggacaggacggccagaattacctggtggaggatacaacagttgggacttcgagtatgtgcacgtcggtaccagacagaacgccgaggccacggccccgtgtacgtggtcacgttctttagccgtacttacccgaacccggcccttgtcgggacttcccgtggaacgcgtacttccgtcgtacggccctaccgaagggtccggggaaaccaccgggaccctacccgtgaacccagtaccgacggaccgaaccgggaccccctaaccgttgggaactacgggaggtacgtacttacgtttccgtagttacgtaaggtcggtagggaaccctaaccgaacgttacgtttggttccggtttaccggttccggggtaacggttaccggggacccggttaacgggtaccccgtaacccggttaccttaaaccgggttccgaacccgggacccccggaaacccgggggtacccccctaaacccccggtaccgttcccgttaccccgaacccgtttcccgttaccccgggtttaccccccctaacccccgttccccttaacccggaccccgtaacccgggg

SEQ ID NO: 272650 - DNA, 661 bp, Homo sapiens
  misc_feature: GYAE6OF01D4FYF.8.87.H10.1.454.CMB.1.raw
  modified_base (378)..(378): a, c, t, g, unknown or other
  misc_feature (378)..(378): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcacgtggtaccagcagaagccaggccacggcccctgtactggtcattctttagcgtacttcccgaaccggcccttcgtgggactcccgtagacgcgtatttcgtcgtcggctaccgaaggtccgggaaacnccggcccaccctgaccagtcagccgacgggacccctaacccgttggactggtagggtcgtaacgttagtttcgtagtacgtaaggttcggtacgggtaccaaacccgtaacgtaccgtttggttacgttccggtttaccggggacgttcgggggaacccgtacgggttaccctacccggttacctaaggtcccgaaccgccccggaacgggaccccaaccccgtccgttcgtacccgaccttaccgtccgttacccccgcccttcccgaccgaccgacccggg

SEQ ID NO: 272651 - DNA, 614 bp, Homo sapiens
  misc_feature: GYAE6OF01BSFCW.8.87.H10.1.454.CMB.1.raw
  modified_base (371)..(371): a, c, t, g, unknown or other
  misc_feature (371)..(371): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggtccctcgtgggactcccgtagacgcgtattctcgtcggcctaccgaaggtccggggaaacnccggcccacccgtgaccatcgacgccgacgggcccaacccgttggatggaggtcgtacttatttcgtgtcgtaaggtggtacgggaccaccgtaactacgtttgtcgttccgttacggggaccgtcggggaaccgtacggtcctacccggtacctaaggtccgacgccccgacgggccccaaccccgtacgtcgtaccaccgttccgttccgttcccccgaccctcccgtccgcccgtaccgg

SEQ ID NO: 272652 - DNA, 519 bp, Homo sapiens
  misc_feature: GYAE6OF01A5Y3U.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggccccctgtactggtcatctatcaagataacaagcggcccctcagggatccctgagcgattctctggctccaactctgggaacacagccactctcgaccatcagccgggacccaggctacggatgaggctgactattactgtcagggcgtgggacagcagcactagtggtggttttcggcgggtacgggaccaacggctggacccgtccgttcggtcacgcccgaacggcctcgcccctcggtcc

SEQ ID NO: 272653 - DNA, 788 bp, Homo sapiens
  misc_feature: GYAE6OF01EBIP5.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagttgtcaggtcggccctggggacaggaccggccaagtaacttaccgtggtaggaaggagtacaaacgtagttacgggactttcgagtatgtcgactacgtacggtaccagacgaaggaacgccgaggtcccacggtcccctagtacgtggtactattacgtttacgcgtaccttacccgaacccggtcccttcgtacgggtacttcccgtaggacgtccgtactttcgtacgtcggcctaccggtaagggtccgggaaaccgtccggaccctacccgtacgaaccctagtaccgacggacccggtaaccgggtacccccgtaacccggttgggacttacggggacgggttaccgtacgtttactttccgtagtaacggtaaggtttcgggacggtaacctaccgtaaacgttcgtttacggtcggttaccggttacggggacccggttacggggtaccggtacggttacccgtacccggtttaccgtaacggttcccgaaccggaccccggtaaccggggtacccctaaccccggtacgtccgtaacccgttaccttcccgttaccccgttacccccgtaccccgtcgttacccggaccgtaaccccggg

SEQ ID NO: 272654 - DNA, 774 bp, Homo sapiens
  misc_feature: GYAE6OF01CFCLA.8.87.H10.1.454.CMB.1.raw
  modified_base (345)..(345): a, c, t, g, unknown or other
  misc_feature (345)..(345): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacagttgggacttcagatgtgcactggtaccagcagaagccaggccacggcccctgtactggtcattcttagcgattacccaaccggcccctcgtgggactcccgtgacgcgatttcncgtcggctaccgaaggtccggggaaccacggcccaccccgtgaacccacgtacgacgacgaccggggtacccctaaaccccgttggggaacgtcggggtaagggttacgtaaccgtttaacgttttccgtacgggttactaaaacgggttcggttacgggggaaccctaaaccgtaaaccttaccgttttcgggttacggtttacccgggtttaccggggaaccgggttacgggggtaaccccgggtaacgggttaccccgtaaccccggttaacccgttaacgggttacccaacccgggtacccccgaaccgggggtaccccccaaaacccccccgttacggttacccgttacccgtaaccgtttccccgttacccggtttcccccccggccccctttacccccgtcccggtaacccgtaccccgggg

SEQ ID NO: 272655 - DNA, 619 bp, Homo sapiens
  misc_feature: GYAE6OF01DDRSM.8.87.H10.1.454.CMB.1.raw
  modified_base (215)..(215): a, c, t, g, unknown or other
  misc_feature (215)..(215): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattaccngtggagagtcaacagttgggacttcagatgtgcacgtggtaccagcaagaagccgaggccacggcccctgtacgtggtcatctttagcgtacttcccaaccggccctcgtagggactcccgtgacgcgtattcgtcgtcggctaccgaaggtccgggaacaccggcccaccgtgaccatcagccgacggaccctaccgtggagtcggaggtatacttattcgtagtctaaggtcgtacgggaccaccgtaacgtacgttcggtgttaccggttcggggacgttcggggaccgtacggtacgacccgtacgtaacgtcgaccggcccgaccgggaccccaaccccgtacgtcgtaccctacctcgttcccgtacccccacccttcccgtccgacccgtaacccgg

SEQ ID NO: 272656 - DNA, 791 bp, Homo sapiens
  misc_feature: GYAE6OF01ASOLG.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgagctgactcacgccactctcagtgtcagtcggccccgggacagaccggccaggattaccgtgggtgggggttacaagttagttgggaaggtaactaagtggtcgcacgtggtaaccagcgaaggaaggcggaggcgacggccctgtacgtggtcagtcgtaggtggggactccgacgtcccggcggtacgggtcgggacccctggccggtacgtactttcgtccgtcgtcctaccgacgtccggtacgggggaacctcccggccctacccgtacgaaccgtactacgaacggacccgaaaccgacccgaacgggtcccggtagtacgtcgggaacggtcgttaacgtttacgtttacgtttttacgggtaccggttagggttacgggtacgggacgtaagtaccggtaactacgtttaacgtttcgtacggtttacccgtttaccgggtacccggttaacgggtaacccgtaacgggttacccgtacccgggttacgtaaccgggtaccgaacccggtaccccggtaacccgtacccccggtaaacccctccggttaacccgtcccggttaaccccttaccccgtttacccgttacccccccgtacccttaaccccggtcccgtaaccccggg

SEQ ID NO: 272657 - DNA, 707 bp, Homo sapiens
  misc_feature: GYAE6OF01B012V.8.87.H10.1.454.CMB.1.raw
  modified_base (654)..(654): a, c, t, g, unknown or other
  misc_feature (654)..(654): n is a, c, g, or t
tcagctcgcgtgtccacgaccggtgctcgatttagcagtactgcgttgggtttggggctgggcctcaggaagcagcagtcgggggtgccgcagccatggcctggaccgctctccttctgagcctccttgctcactttacaggttctgtggcctcctatgaactgacacacgccactctcagtgtcaggtcggcccgtggggacaggaccggaccaagtaacttaccgtggtgggaggagtacaactagttagggacttcgagatgtcgcacgtaggtaccagacaggaacgccgacggcccacggcccctaggtactacggtcacgttcttacgcgtacttaccgacccgtcctcgtcggactcccgagacgcgtacttcgtcgtcggtacgtaccggaacgggtacccggggaaaccaccggcccaacccgtacgaacccgagtaccgacggacccgtaccgggtacccctaaccggtagggtaacgtacgggtacgggttacgtactttagtttccgtaggtacctaagggtcggtacgggaacctaaccggtaacttccgttgggtcgttaccggttaccgggacgttccggggaaccgtacggtccgtaccgtacgtacgccgaccgacccggaccggacccaaccccgngtccgacctacgttccctaccgttaccccacccgtccctaccgaccgtaccgg

SEQ ID NO: 272658 - DNA, 848 bp, Homo sapiens
  misc_feature: GYAE6OF01AI3DY.8.87.H10.1.454.CMB.1.raw
  modified_base (214)..(214): a, c, t, g, unknown or other
  misc_feature (214)..(214): n is a, c, g, or t
tcagctcgcgtgtccacgaccggtgctcgatttagcagtactgcgttgggtttggggcgtgggcctcaggaagcagcatcgggggtgccgcagccatggcctggaccgctctccttctgagcctccttgctcactttacaggttctgtggcctcctatgaactgacacagccactctcagtgtcagtgccctgggacagacggcagaattaccngtggaggagtcaacattgggacttcgagatgtcgcactggtaccagcaagacgaccacggccacggcccctgtaccgtggtacagttctttagtaccgtacttacccgaaacccggtccccttcgtaccgggtaacttcccccgttaggacgtaccggtactttaccgtcgtacgggtacctacccgaaacgggttacccggggaaaccgtaaccgggacccctaacccccgttacggtaacccctaacgtaccgtaaccggacccggaaccggggtacccccgtaaacccggtttccgggtaaacgtcggggtaaacgggttacggtaaccgtttaaacgttttcccgtacggttaccgtaaagggttcggtacgggaacctaacccgtaaaccgttaccgtttacggttcgggtttaaccgtttcccgggggtaacgttccgggggtaacccggtacgggttaccccgtaacccggtttacccggtaaacggttcccggaaaccggtaaccccggaaccgggtacccccgtaacccgtaacccgtttcgggtaacccttacccggtttaccccgttccgggtttacccccccgtacccccttaccccgttacccgggacccgtaaccccggg

SEQ ID NO: 272659 - DNA, 811 bp, Homo sapiens
  misc_feature: GYAE6OF01BHOG7.8.87.H10.1.454.CMB.1.raw
tcagctcgcgtgtccacgaccggtgctcgatttagcagtactgcgttgggtttggggctgggcctcaggaagcagcagtcgggggtgccgcagccagtggcctggaccgctctccttctgagcctccttgctcactttacaggttctgtggcctctatgaactgacacacgccactctcagttgtcaggtcggtcccgtggggacaggaccggccaagtaattaccgtgggtaggaaggagtacaaacgtagttcgggacttcgaggtagtggtgacgtacgtacggtaccaagacgaagaacggccgaacggcccgtaccggtccccgtaggttaccgttacggtacctacgtttacgttttacggacccgttaccgttaccccgaacccgggtccccttaccggtacggggtaccttccccgtaggaccggtccgtacgtttaccgtccgttacgggtacccgtaccggtaaacggggttacccgggggaaacccgacccggtaccccacccgtacggaccctaacgttaccgaaccgggtacccggaaccgggtaccccgtaaccggttggaacggtacgggtacgggttacgtaacgtttatttccgtacggtacggtaggttcgtaccgggaacctaactaacccgtagtttcgtacgttccgggtacggtacgggtccgggaccggtacgttacccgaccggttaccgaaaggtcccaccggaccgtacccggacccctaacccgtacgttccgtacctacgtcccttcccggtcccctacccgtcccgtacccgtaaccgccgg

SEQ ID NO: 272660 - DNA, 727 bp, Homo sapiens
  misc_feature: GYAE6OF01EIT79.8.87.H10.1.454.CMB.1.raw
  modified_base (423)..(423): a, c, t, g, unknown or other
  misc_feature (423)..(423): n is a, c, g, or t
  modified_base (521)..(521): a, c, t, g, unknown or other
  misc_feature (521)..(521): n is a, c, g, or t
  modified_base (537)..(537): a, c, t, g, unknown or other
  misc_feature (537)..(537): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
tcagctcgcgtgtccacgaccggtgctcgatttagcagtactgcgttgggtttggggctgggcctcaggaagcagcagtcgggggtgccgcagccatggcctggaccgctctccttctgagcctccttgctctactttacgaggttctgtggcctcctatgaactgacacagccactctcagtgtcagtcggccctgggacagcggccagtaattacgtggtggggttacagttagtggaaggtaacagtgtgcagtgtacagcgagaaggcgagggcacggtccctggtactggtcacttcgtagggtcggggtaacttccgacggttccgggaccgtacggggtccgggaccccgtggccggtacgtactttccgtccgtaccgtcccgtaccgtacggttacccggtaccgggggaaccncccgggtaccctacccgtcgaacccgtagtaccgaacgaaccaaaccgcccgtaagggtcccgtagacgtggaacgtcttagtaacttttgtttacgngtagggtggtggaccngctagtnttagttntacgtcgttaccggacgttacggaacctacggtccctaccggttacgtacggtacccgaaccggtacccggaaacccggtaccccctaacccggtagttccccgggtaacctaccccgttttccggttacccccccgtttcccccgtacccggttacccctccgggtaaaccccgg

SEQ ID NO: 272661 - DNA, 737 bp, Homo sapiens
  misc_feature: GYAE6OF01EL915.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagccctccttgctcactttacaggttctgtggcctcctatgaactgacacagccactctcagtgtcagtggccctgggacagacggccaagtaacttacctggtggaggagtacaactagttgggaccttcgagatgtgctacgtggtaccagcagaagccaggccacggcccctgtactggtcattcgttagcgtatccgaaccggtccctcgtgggactcccgtgacgcgtatttcgtctcggcctcgaaggtccgggaaccacggcccacccgtgaccctaatccacggtacgacgggaccccctaaccgttagggacttagggacgggttataaccgtttagtttacgtcgggttaacgtaacgggttcggttaaccggggaaccctaaaccccgtaaaccgtaccgttttacgggtacgtttaccgggttaccggggtacgggtaccgggggtaccccggtaacgggtccctaaccccggttaccgtaaacggttacccgaaccggaacccccggtaccgggaacccctaaaccccccgtacgttaccgtaccccgtacttcccgttcccggttaccccccggtccccttacccgtccggaaccctaacccggg

SEQ ID NO: 272662 - DNA, 752 bp, Homo sapiens
  misc_feature: GYAE6OF01A4PPD.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtcggccctgggacagacggccagaattacctggtggaggagtcaacattgggacttcagatgtgcactcggtaccagcaagaacgccgacggaccacggccccgtgtacgtgtcattcttagcgtacttcccgaaccggtcctcgtcggactcccgtgacgtcgtattctcgtcggcctaccgaagggtaccgggaacgtacccggaccctacccgtcgaaccgtataccgaacgcccggacgggaccccttaaaccgttgggacgtaggtacgggttcgtaactttagtttccgtacggttcgtaaacgggtcggttaacgggaacctaacccgtaacttacgtttcggtacgtttacccgggttacggggtacccgttcggggggaacccgtagggttacccctaacccgggttaacgttaaccggttacccggaccgaccccgggtaacccgggtaccccctaaacccccggttcggttaccggttacccctacccgtttccccgttccccgggtttacccccccaccccggtttcccgtaccccgggaacccggtaacccggg

SEQ ID NO: 272663 - DNA, 948 bp, Homo sapiens
  misc_feature: GYAE6OF01DFAU0.8.87.H10.1.454.CMB.1.raw
  modified_base (87)..(87): a, c, t, g, unknown or other
  misc_feature (87)..(87): n is a, c, g, or t
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
tcagctcgcgtgtccacgaccggtgctcgatttagcagtactgcgttgggtttggggctgggcctcaggaagcagcagtcgggggtnccgcagccatggcctggaccgctctccttctgacgccctccttgctctactttacgaggttctgtcggcctcctatgaactgacacacgccactctctaggtgtcgaggtcggccctagggaccacggaccgccaagtaacttacgnggtaggaggtatacaacgtagttacgggacctttgaagtnttcggacgtcctaacggttcggtaacccgaaggaccgaaagggaaaccggcccgggaaccgggtaccccgtaacccgggtccccgtttacggggttaaacccggtttcgggttaccttaacggttttacccggttttaacggtccccggtaaccgtttaaccccccgggaacccggttcccccgtttaccgggtaccggggttacccctttcccgtaaggggaccgtaccctttaaccgtttccggtaccggttacccgggtaccgttaaccccggggtaaacggggtttaacccccgggggaaccgacccccggtacccctaccccgtacggaaccctcgtaacccggacccggaaccccgggacccgggtaccccttaaacccgggttgggtaacggttcgggttaacggttaccgtaagtttccgttacggtaacgtcggtaaggtaccgggtacggtaacccctaacgtaactttcggttacgggtttcccttaccggggttaaccgggtaccgggttacccgggggaacccgttacggtacccgttaacccggtaacggttaccgccggtaaccccgacccggacccggtaacccgtacccttccggtactaccccgttacgtcccctacccgttaccccccgacccgttccgaccgacccgtaccggg

SEQ ID NO: 272664 - DNA, 775 bp, Homo sapiens
  misc_feature: GYAE6OF01C7KGP.8.87.H10.1.454.CMB.1.raw
tcagctcgcgtgtccacgaccggtgctcgatttagcagtactgcgttgggtttggggctgggcctcaggaagcagcagtcgggggtgccgcagccatggcctggaccgctctccttctgagcctccttgctcactttacagttctgtggcctcctatgagctgactcagccactctcagtgtcagtcggccccggacaggacggccaggaactttaccgtgggtcggggggttacaattagttagggaagtaacagtgtgctacgtggtaaccagcaggaagcgagggcacggccctgtacgtggtcatcgtagtggggatccgagtcccggacgtacgggtccgggaccccctggaccgcgtaacgtttcctccgtcgacccgtccacgttccggtaccgggggaaccgccggacccgtaaccgttcgaacccagtacccgagaacccgaaacggaccccgaaggtcccggtagacgtagggtacgtacgttacgtaacgttttacgttttgtaccgtagggtttaggtacggaaccgtaggacgaaggtaccttaacgttttaacgttcggttaccgtttaaccgggaaccgtttacggggaaacccgttaacgggtacccgtaaccccggttaccgttaacgggtaccctaaaccgggtaccccgtaaaaacccggcccccaaaaacccccgttggttaacccccgttacgaacccttttacccggtaccccgtttacccccaccccccgttaccgttacccggaaacccgg

SEQ ID NO: 272665 - DNA, 741 bp, Homo sapiens
  misc_feature: GYAE6OF01A08BJ.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggacccgctcctccttctgacgccgtccttgcctctactttacaggttctgtcggcctcctatgaactcgacacacgccactctcagtcgtcaggtcggcccgtgggacacggaccggccgacggtacgttaccgtgggtggggggttactaagttacgttaggacggtaactagtgtacgctacgtggtaccagaccaggacggcgacggtaccgaccggtccccgtggtacctcggtacacgttacgtacgggtagggtaaccgtccgtaacggtcccggaccggtacgggtaccggaccccgtggaccgacgttcgttcctcgtcgaccctcgtacggtccggtaccgggaaccgcccgacctaccgtacgaccttacgaccacgtaccaaccgtcccgtaacgggtccgtaagcggtaggacgtacgttgttaaccgtttaggttttcggacgttaacggggtcggttaacgacgtgaccgtgtaaccctttaggttacgtccgttaccggtccggaccggttacggacctaacggttccaaccggttacgttccgaaccaccgtacccgaaccgttccccaacctccgtacgcccttccctacgtcccccgtaccctcccgcgttccggaacccg

SEQ ID NO: 272666 - DNA, 708 bp, Homo sapiens
  misc_feature: GYAE6OF01BIUMR.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacaggaccggccaggacttaccgtggtgggggttcaagtattggaaggttaacaagtgtgcactggtaccagcaaggaaggcagggcacggcccctgtaccgtggtctattctttagcgtacttcccgaacccggtccctcgtcgggacttccctaggacgtcgtacttcctcgtcggctaccgaagggtaccgggggaaccacgggcccaacccgtgacccacgtcgacgaccgacgggacccctaaccggttgggacttgggaacgggttcgtactttacgtttcgtaggtaactaaggttgggtacgggacctaaccgtaactacgtttgttcgttaccgttacggggacgtacggggacccgtacgggtacccgtacccgtacgttaacgccgaaccggtcccggaacgggaccccctaaaccccgtcgttccgtacccaccgtttcccgttacccgttccccccaacccctttcccgacccgtaacccgacccggcggccggtaccgg

SEQ ID NO: 272667 - DNA, 879 bp, Homo sapiens
  misc_feature: GYAE6OF01ENHWY.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggacccgctctccttctgacgcctccttgctcactttacaggttctgtgcctctatgaactgacacagccactctcagtgtcaggtcggccctgggacaggtaccggcctaagtaactttcgtggtaggaaggactacaaactagttagggacttacagtagtgtagcacgtacggtaccagaccgaagaaccgccgaacggccgaaccggtcccctagttaccgtcgggttactactttacgtttacggaccgtaacgtttaccccgaacccgggtccccttacggtacgggtaaccttccccgttaggaacgtcccttagttcctacggtaccgggaccttaccgaaacgggggtacccggggtaaaccacccggtacccctaacccgtacgaacccgtaagttaccggaaacggggttaacccgggaacccctaaccggtttacgggaacgttacggggtaacgggtttacgtaaccgtttaacggtttccggtacggtaacggttaacggtcgggtaaccgggtaacctaacccgttaacgttaccggtttcggttacgggtttaccgggtttaccggggtaaccgggtacgggggtaacccggtacggttacccgtacccggttaaccggttaaccggtaccaacccgggtacccccgtaaaccgggtaacccccaaaccccggttacgtttaccgtacccgtacccgttcccggttacccccggttacccccgtacccccttacccgtaacccgacccgtaccgggtacccg

SEQ ID NO: 272668 - DNA, 833 bp, Homo sapiens
  misc_feature: GYAE6OF01CTNSG.8.87.H10.1.454.CMB.1.raw
  modified_base (247)..(247): a, c, t, g, unknown or other
  misc_feature (247)..(247): n is a, c, g, or t
tcagctcgcgtgtccacgaccggtgctcgatttagcagtactgcgttgggttggggctgggcctcaggaagcagcagtcgggggtgccgcagccatggcctggaccgctctccttctgacgcctccttgctactactttacgaggttctgtcggcccttcctagtcgaactgaacacagccctactctcgagttcgtcgacggtcggtcccgtgggacacggaccggaccaaagtaacgtttaccgnggttagggaagtacgtacctaaacgtggttacgggacctttacgaagtacgttcgtcgaccgtacgttacggaccagaccaaggaaccgaccgacggacccgacggtccccttaggtacgtcggtactacgtttcgttaacggccttaaccgttcccggaaccggtcccttacggtcgggtaccttcccgtaggacgtacggttattccgtagtaccgtcaacccggtaacgggtaccgggaacccaccggacccctaccgacgtaacctacgtaccgacgtaccggaacccgggtaaccccgtaacggtgtaaccggtagggtacggttaccttacgttacgtttacgacggttagtaaccggtcgacgtaaccaaccgtacgttcgttacgggttcgttacccgggtacggtacgggtacgggtaaccgtacgtacccgttaccggtaacgttaccggaccaccccgggtaaccgtaaccccgggtacccccaacccgttagttcccggttaacccgtaccgtttccccgttaaccccccgttaccccaaccccgttcccgtaagggacccccgttaaccgggg

SEQ ID NO: 272669 - DNA, 528 bp, Homo sapiens
  misc_feature: GYAE6OF02G0NRU.8.87.H10.1.454.CMB.1.raw
  modified_base (425)..(425): a, c, t, g, unknown or other
  misc_feature (425)..(425): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctagtgggggatccgatccggccaggtcgggacccctgcgcgattctctgcctcatcgtcggggaacgcggccacctgaccatcagcaagcccaagccgtgatgaggctgacttattttgtcaggtgtgggacngcagctatttatgtcttcggacctgggaccaaggtcaccgtctaggtcacgcccgaaggcccaacccactcgtccactctcgttccccaccctcctccgaccg

SEQ ID NO: 272670 - DNA, 516 bp, Homo sapiens
  misc_feature: GYAE6OF02HR20Z.8.87.H10.1.454.CMB.1.raw
  modified_base (230)..(230): a, c, t, g, unknown or other
  misc_feature (230)..(230): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
  modified_base (484)..(484): a, c, t, g, unknown or other
  misc_feature (484)..(484): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaaanattgggacttcagatgtgcactggtaccagcagaagccagccaggcccctgtactggtcatctttagcgattccaacggccctctgggactccctgagcgattctctgctccaagtcgggaacacggccaccctgaccatcagcagggcccaaccttggatgagggtnactatttcngtcaagtgtaggacaccaacncttgtgtcttcgggacttggaccgagtccacgtctagcacgcccagggccaacccntcgtcactctctccccaccctcctcgaccacg

SEQ ID NO: 272671 - DNA, 508 bp, Homo sapiens
  misc_feature: GYAE6OF02GHK6Y.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtatcagcagaggccaggccagtcccctgtactggtcatctatcaagataacaagcggccctcagggatccctgagcgattctctggctccaactctgggaacacagccactctgaccatcagcgggacccaggctacggatgaggctagactattactgtcaggcgtgggacagcagcacgtatgtggtttcggcggagggaccaaggcctggaccgttccgttaggtcacgcccgaaggcctcgccccctacgg

SEQ ID NO: 272672 - DNA, 559 bp, Homo sapiens
  misc_feature: GYAE6OF02IS622.8.87.H10.1.454.CMB.1.raw
  modified_base (514)..(514): a, c, t, g, unknown or other
  misc_feature (514)..(514): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcattcttagcgattccaaccggccctcgtgggactccctgacgcgacttctcgtgctccgaaggtcggggaacacggcccaccgtcgaccatccagcgacgggccccaaccgttggactggaggtgacttatttctgtcaagtggtacggaccaccaactacttgtgtccgttcgggactggggacctggtcaccgttacaagtccagcccgagggccctaacccngtcgtaccacgttcctccgttccccaccctcctaccgactaccgg

SEQ ID NO: 272673 - DNA, 549 bp, Homo sapiens
  misc_feature: GYAE6OF02GI5A2.8.87.H10.1.454.CMB.1.raw
  modified_base (358)..(358): a, c, t, g, unknown or other
  misc_feature (358)..(358): n is a, c, g, or t
  modified_base (469)..(469): a, c, t, g, unknown or other
  misc_feature (469)..(469): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggtccctcgtgggactccctgagcgattctctgctccaaggtcgggaacncggccacccgtgaccatccagccgacgggcccaacccttggatgagggtgacttattctgtcaagtgtagggacaccgaacacttgtcgtcgttcgggactcggggaccgnggtaccaccgttcctaacgtcacgcccgacgggcccaaccccgatcgctactctcgttccccacctcctccgaccaccgg

SEQ ID NO: 272674 - DNA, 690 bp, Homo sapiens
  misc_feature: GYAE6OF02IH9E4.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaacgccaggccacggcccctgtactggtcattctttagcgtacttacccgaaccggtcccctcgtcgggacttccccgtgacgcgtacttcctcgtcggtctaccgaacgggtccggggaaacaccgggcccaacccgtcgaaccctataccgacggaccgaaccggggtccccctaaaccgttcgggacgtgggtaagggttcgaacgtttaactttccgtagtacgtaagggttcggtacgggaacctaaccgaactacgtttcggtcggttacggtttcggggaccgtcggggaacccgtacggtaccgtacccggttccttaaggtccaccgtaccccggacgggtaccccaaccccgtcgttacgtaccaccgttcccgttccggtttaccccccaccccgttccctacccggacctacccgg

SEQ ID NO: 272675 - DNA, 618 bp, Homo sapiens
  misc_feature: GYAE6OF02H3PBQ.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattaccgtggtgggggttcaatagttggaggtaacaatgtgcactggtaccagcaaggaaggcgagggcacggcccctgtactggtcatcgtagtgggggactccgagtccggccagggtcgggacccctggcgcgtattccgtcgtcgcctcctaagtccgtaccggggaccgccggcccacccgtcgaacccactccgaacgaccaaaaccgcccgaacggccggtagagtcggacggctgtactttagttttgtcgtagggttggtacggacgagcgagctagtttcgtgttccgttcggaccgtacgggaccaacggtccaccgtcgtacggtcgacgacccgaaccggacccaacccgacgtcgtacctaccttccgtccgttccccgtccctccgtaccgaccg

SEQ ID NO: 272676 - DNA, 611 bp, Homo sapiens
  misc_feature: GYAE6OF02ICHYB.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgtattccaaccggccctcgtgggactccctgacgcgattctctggctccgaagtcgggaacacgggccaccctgacccatccgaagcgacgggcccctaacccgtttgggactggagggttcgacttatttctgtacgaagttgtagggaccacaactacttgtcgttacgttcgggacgtcggggaccgtaggttccgacccgttcgtaacgtcaccggccccgaacgggccccaaacccccgacgttaccggtacccaccgttaccttccggtttacccccacccccgttcccgtacccggacctacccgg

SEQ ID NO: 272677 - DNA, 734 bp, Homo sapiens
  misc_feature: GYAE6OF02GI0BW.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttacgcgtacttccgaaccggccctcgtgggactcccgtgacgcgtacttctcgtcggtcctaccgaaacgggtccgggggaaaccgaccgggacccctaaccccgtcgaacccacttaccgacggaccgaaccggggaccccctaaacccggtttgggacgtacgggtaacggggttacgtaaccgtttatttttccgtacggttaccgtaaacgggttcgggttacggggaacctaacccgtaaaccgttacgtttacgttcggttaccggtttaccggggtaaccgtcgggggaacccggtagggttacccgaacccgttaccgtaacgtccgtaccgggaccccgaacgggtccccctaaaccccgtcgtaccgttaccctacgtttccttacccggtttacccccaccccgtttcccgtacccgtaccgtacccgg

SEQ ID NO: 272678 - DNA, 682 bp, Homo sapiens
  misc_feature: GYAE6OF02I9199.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcaggtcggccctgggacagacggccaagaattaccgtgtggaggatcaaacagttgggacttcagatgtgcactggtaccagcgaagaagccaggccacggcccctgtactggtctattctttagcgacttaccaaccggtccctcgtggactccgtgacgcgtattctctcggctaccgaacgggtcgggaaccaccggcccgacccgtacgaccgtatccgacgaccgaccgggtacccaaccgttgggaacgtcggtacgggtacgtaacgttactttcgacgttacgaagggttacgtacgggaacctaaccgtaatccgtttagtcggttaccgttaccggggtacgtaccggggtaccgtacggttcccgaaccgttacccgtaaggtacccgacggtcccgaaccgggtacccccgtaacccgtcggttaccgtaccgtaccgttcccgttacccgttacccccgaccctttccgtacccgaccgtaacccgg

SEQ ID NO: 272679 - DNA, 546 bp, Homo sapiens
  misc_feature: GYAE6OF02H6Z8D.8.87.H10.1.454.CMB.1.raw
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (403)..(403): a, c, t, g, unknown or other
  misc_feature (403)..(403): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaaacattgggacttcagatgtgcactggtaccagcagaagccaggccaggcccctgtacnggtcatctttagcgattccaaccggccctntgggatccctgagcgtatctctggctccaagtcgggaacacggccaccctgaccatcagcagggcccaacccgttggatcgagggtnacgtatttctgtcaagtgtagggactacgaacacgttgtacgtcttcgggacttgggaccgtaggtccacgtcctaagtcacgcccgagggcccaaccccacgtcgtccactcgtacgtccccaccctcctaccgactaccgg

SEQ ID NO: 272680 - DNA, 563 bp, Homo sapiens
  misc_feature: GYAE6OF02H7WMJ.8.87.H10.1.454.CMB.1.raw
  modified_base (515)..(515): a, c, t, g, unknown or other
  misc_feature (515)..(515): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggagggagtcaaactagttgggacttcagatgtgcacgtggtaccagcaagagccaggccaggcccctgtactcggtacattcgttagcgtacttccaaccggccctcgtggactcctgacgcgtatctctgctcgaaggtcgggaacacggcccacctgaccatcacgcacgggcccaaccgttgagtcggaggtcactacgttctgtacgagtgtaggaccaacactacttgtgttacgttcgggacgtgggaccgagtccacgtccgtaagccacgcccgacggcccaacccgtntcgtaccacgtcctaccgtaccccacccgtacccgacccacgtaccgg

SEQ ID NO: 272681 - DNA, 729 bp, Homo sapiens
  misc_feature: GYAE6OF02GOYB1.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacaggacggccagaattacctgtggaggatcaaactagttgggacttcgaagatgtgcacgtggtaccgagacacgaacgaccgacggaccgacggccccgtcgtacgtggtcgtactcgttacgtcgtacgttaccgtaacccggtcccgtccgtcgggtaaaaaaaaacgtcccgtacgtacgacgtacgttcgtcgtcggtccgtaccgaacggtaccggggaaccgaccggacccgacccgtacgaccgacgtaccgacggaccgaccgggaccccgtaacccgttacggacgtaggtacgggtacgtacgttaacgtttacgttacgtacgtaaggttacggtacgggtaaccgaaccgtaaccgtaacgttcggttacggttaccgttaccgggtacggtacgggtaccggtacggtaccgtacccgtaccgtaacgtaccgtacgaccgaccggacccgaacccgtaccgtacgtaccgtaccgtaccgtaccgttcccctacccctacccgtaccgaccgtacccg

SEQ ID NO: 272682 - DNA, 763 bp, Homo sapiens
  misc_feature: GYAE6OF02IWMV8.8.87.H10.1.454.CMB.1.raw
  modified_base (380)..(380): a, c, t, g, unknown or other
  misc_feature (380)..(380): n is a, c, g, or t
tcagctcgcgtgtccacgaccggtgctcgatttagcagtactgcgttgggtttgggctgggcctcaggaagcagcatcgggggtgccgcagccatggcctggaccgctctccttctgagcctccttgctcactttacaggttctgtggcctctatgaactgacacagccactctcagtgtcagtggccctgggacagacggccagaattaccgtgtggaggagtcaaactgttgggaccttcaagatggtcgcactggtaccagcagaagccaggccacggccctgtactggtcattcttagcgacttccgaaccggtccctcgtcgggactcccgtgacgcgtacttcctcgtcggcctaccgaaggtccggggaaccnccggtacccaaccgttcggaccacgtacgacgaccggtaccgggtaaccccctaaacccggtttgggaaaccgttgggaaacgggttcgtaaccgtttaacgttttccggagttaaccgtaaagggttccgggtacggggtaacccaaacccggttaacgaccggttttacgggtccggtttacccggtttaccggggaaccgttcggggtaacccgtacggggtacccgtaaacccggttacccgtaaacgggttcccgaaccggtccccggtaaaccggggtaaccccctaaacccgtaccgttacggaacccttaaccgttcccggttaccccggttaccccccgtacccccgtacccgttaccggtaacccgtcccggg

SEQ ID NO: 272683 - DNA, 685 bp, Homo sapiens
  misc_feature: GYAE6OF02H8WOA.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcaagaagccgaggccaggcccctgtactggtcattctttagcgtattcccaaccggccctcgtcgggactccctggacgcgtacttctcgtggctaccgaaggtcggggaacaccgggcccacccgtgaccatccgacgccgacgggcccctaacccggttggacgtcgggaagggtctaacgttattttccgtaggttacctaaagggttgggtacggggaaaccctaacccgaaacgtaaccgtttggttacgttaccggtttacggggaccgttacggggaccgtaacgggttcccgaaccccggttacgtaacggtccacggccccgaaccggggccccctaaacccccgacgttccggtaccctacccgtttcccgttccggttccccccgaccccttcccgtacccggaccctacccggg

SEQ ID NO: 272684 - DNA, 659 bp, Homo sapiens
  misc_feature: GYAE6OF02H94MJ.8.87.H10.1.454.CMB.1.raw
tcagctcgcgtgtccacgaccggtgctcgatttagcagtactgcgttgggtttggggctgggcctcaggaagcagcatcgggggtgccgcagccatgggcctggaccgctctccttctgagcctccttgctcactttacaggttctgtggcctcctatgaactgacacagccactctcagtgtcagtggccctgggacaggacggccagaattacctggtggaggagtcaaactattggggacttcagatggtgcacgtggtaccagcaaggaagccgaggccacggcccctagtactggtcattctttagcgtacttccgaacccggtccctcgtggactcccgtagacgcgtatttcgcgttggcctaccgaagggtccggggaaacaccggcccaccctcggaccacgtcacgcgaccgggacccctaaccgtggacgtaggtaggtacgtacttactttcgtagtactaaggtgtacgggacttaccgaactcgttagtcgttacgttcgggtacgtcgggtacgtacggtacctaccggttacgtaacgtcctaccgggaccccgtaccgggaccccaaaccccgtcgtaccgtaccctaccgtccgttacccggttcccccgaccccttcccggttacccgacctaacccggg

SEQ ID NO: 272685 - DNA, 786 bp, Homo sapiens
  misc_feature: GYAE6OF02F12SS.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacagttgggacttcagatgtgcactggtaccagcaagagccaggccacggcccctgtactggtcatctttagcgtacttcccgaaccggcccttcgtcggggtacttccccgtaggacgccgtaatttccgtacgtcgggtccttaccgaaagggttcccgggggaaacctaccgggacccctaaccccgttacggaacccctacgttacccgaacggacccgaaccgggggtacccccctaaaccccggtttggggaacgttcggggaaggggttacgtaaccgtttacgttttccgtacggttaccgtaaaggttcgggtacggggaaccctaaacccgtaaaccgtaccgttttgggttaccgttaccggtttaccggggaccgttaccgggggtaacccggtacgggttcccgaaaccccggtttaccaaacgggttcccaaccggccccggtaacggggtacccccaaacccccggttactaccggttacccgtacccgtttccgttccggtttccccccgacccccgtttcccgtacccgaccgtaacccggg

SEQ ID NO: 272686 - DNA, 656 bp, Homo sapiens
  misc_feature: GYAE6OF02F41TY.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacaggacggccagaattacctggtggaggagtcaactattgggacttcagatgtgcactggtaccagcagaagccaggccaggcccctgtactggtcattcttagcgattcccgaaccggccctctcgggactcccgtgacgcgtattctcgtggcctacgaaggtcgggaaccaccgggacccaccgtcggaaccacgtcagccgacgggaccctaacccgttggactgggaggtcgacttagttctgttacgaaggttcgtacggaccaaccgaacgtacgttgttgtaccggttcggacggtacgggaccgtacggttaccacccggttacgttacggtaccgtacggccccgtaacgggcccctaaacccccgacgttccgtaccctaacccgtttcccgttacccggtttaccccccgtacccccgtttcccgtacccggtaacccgtaaccccgg

SEQ ID NO: 272687 - DNA, 693 bp, Homo sapiens
  misc_feature: GYAE6OF02JV56A.8.87.H10.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (504)..(504): a, c, t, g, unknown or other
  misc_feature (504)..(504): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctctatgaactgacacagccactctcagtgtcagtcggccctgggacaggaccggccagaacttaccgnggtggaggagtcaaacngttgggacttcagatgtgcactggtaccagcagtaacgccaaggccagggccccctggttacctgggtcctagttcctttagccgtactttaccccgaacccggtcccctacgtcgggtaactcccccgtggaacgccggtaattcctcgtcggcctccgaaggtccgggaaacgtaccgggccctaacccgttacgacccgaacttccgaacgaccgaaaccgacccgaaacggcccggtagaacgtcgacggtctaacgtacgttnttttcggactagggtgtcgggactaggcaggccttatttaggccgtttcgttaccggtaccgttaaccggggacctaaagggttccctacccgtacgtacggtccgaacggtaccccaaagggcccccaaccccgtattacggtaccccaacggttcccttaccggttacccccgtccccgttaacccg

SEQ ID NO: 272688 - DNA, 654 bp, Homo sapiens
  misc_feature: GYAE6OF02ILPNQ.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtacaacattgggacttcagatgtgcactggtaccagcagaagccaggccaggcccctgtactggtcattctttagcgtacttccaaaccggccctcgtacgggacttcccgtgacgcgtattctcgtggctaccgaaggtacgggaacaccgggccaacccgtcgaccactccacgtcacgggacccctaaaccgttggactaggagggttcgaacttatttactgttactaaggttgtacgggaaccaaccgtaactacgtttgtcgttacgttaccgggacgtacggggtaccgaggtccgtaacccggttaccgttaaacgtccgacggaccccgaacggggaccccaaacccccgtacgtaccgtacccgtaaccgttcctaccggttttaccccccaccccgttcccgtacccgacgtaacccgg

SEQ ID NO: 272689 - DNA, 765 bp, Homo sapiens
  misc_feature: GYAE6OF02IWSSB.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtcggccctgggacagacggccagaattacctgtggaggagtcaacattgggacttcagatgtgcactggtaccagcagaacgccaggccacggcccctgtactggtcattctttagacgtattcccgaaccggtccctctcgggactccccgtgacgcgtacttcgtctcggtacctaccgaaggttacccggggaaaccaccgggtacccctaaccccgtgtaacccgtacgttaccgaacggaccgaaccggggaccccctaaaccccggtttagggaacgttcgggaacgggttacgtaccgtttaacgtttccgttacgggttaccgttaaacgggttcgggtaccgggggaaccaacccgtaaacctaaccggttttacgtcggtttccgtttacggggtaccgttacgggggaacccggttacgggtacccgtaacccgtaccgttaaccgtccgaccggaccccggaacggggtaccccctaaacccccgtcgttacccggttacgtacccgttacccgttacccggttaccccccttaccccgtcccggttacccgtacccgtaaccccggg

SEQ ID NO: 272690 - DNA, 702 bp, Homo sapiens
  misc_feature: GYAE6OF02JBI0Y.8.87.H10.1.454.CMB.1.raw
  modified_base (414)..(414): a, c, t, g, unknown or other
  misc_feature (414)..(414): n is a, c, g, or t
  modified_base (522)..(522): a, c, t, g, unknown or other
  misc_feature (522)..(522): n is a, c, g, or t
  modified_base (552)..(552): a, c, t, g, unknown or other
  misc_feature (552)..(552): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagccctccttgctcactttacaggttctgtggcctccttatgaactgacacagccactctcagtcgtcaggtcggccctggggaccaggaccggtaccaaggaaatttaccctggtagggacggagttccaaactagttggggaacctttcgaggtattggtcgacgtacctacgggtaacccagacagaaacgtccaacggccgaacggccccctaggtaaccttcgggtctacttcgtttaaggccgttacttccgaacccggcctcgtggacttccctgacggtcactttccngtcggtcctacccgtagggtaccgggaaaccaccggccctacccgtcgaaccactacacggccacgggacccctaaccgttcggagtggacggtgtacttagttcgtntacgagtggcggacctacgaactaccgttntcggttacgtcgggtacgtcgggaccgtcgttccgaccggttaacgtacgtccgaccgacccggacggggtaccccaacccttaaccgtcgtaccctaccgtttccgtacccggttttcccacccccgttccgtaccgcccgtacccggg

SEQ ID NO: 272691 - DNA, 857 bp, Homo sapiens
  misc_feature: GYAE6OF02GX2W3.8.87.H10.1.454.CMB.1.raw
tcagctcgcgtgtccacgaccggtgctcgatttagcagtactgcgttggggtttggggctgggcctcaggaagcagcatcgggggtgccgcagccatggcctggaccgctctccttctgagcctccttgctcactttacaggttctgtggcctcctatgaactgacacagccactctcagtgtcagtcggccctgggacagacggccagaattacctgtgggaggagtcaacagttgggacttcagatgtgcacgtggtaccagcgaagaacgccgaggccacggcccctgtactggtcatctttagcgacttcccgaacccggccctcgtcgggactcccgtggacgcgtacttctcgtcggcctccgaacggtaccggggaaccgacccggacccacccgtacgaaccctacgtaccaacggacccgaccggggtacccccctaaacccgggttcggggtaacggtacggggtaacgggggttacgtaaccgtttacgttttaccggttcgggtttaaccgtaaaggggtttcgggttaaacgggggtaaacccctaaaccccgtaaaaccgtttaaccggttttccgggttaccgggtttacccgggtttaaccgggggtaccgggtttacccgggggaacccgggttaaccgggttacccggttaacccccggttaacccggttaaacgggtacccgtacccgggtacccccggaaccccgggggaacccccgtaaaccccccgtaaccggttaccgttaaccccgttaccccgtttacccccgtttacccggtttaaccccccccctaccccgtttaaccccccgttcccggtaacccccggtaaccccggg

SEQ ID NO: 272692 - DNA, 905 bp, Homo sapiens
  misc_feature: GYAE6OF02JLV1H.8.87.H10.1.454.CMB.1.raw
  modified_base (90)..(90): a, c, t, g, unknown or other
  misc_feature (90)..(90): n is a, c, g, or t
  modified_base (214)..(214): a, c, t, g, unknown or other
  misc_feature (214)..(214): n is a, c, g, or t
tcagctcgcgtgtccacgaccggtgctcgatttagcagtactgcgttggggtttgggggctgggcctcaggaagcagcactcggggggtnccgcagtccatggcctggaccgctctccttctgagccttccttgctctactttacaggttctggtcggcccttcctatcgtaactgacactagccactctcgagtgtcagtcggcccgtggganaggaccggccgaaggtaactttacctgggtaggacgggtacgttaccgaaactggtttacgggtacctttacgaacggtattacggtcggacctaccgttacggttaaccgtacggtacgtaacggtaacggaccccggaaccgggacccgtaccgggtccccccgttaaggttaccggttccggggttaacctaacgttttaccgggtttaacggacccggttaaccgtttacccccgggtaaacccccgggttcccggttccgggttacggggtacccgttcccccggtaagggaccgttaaccggtcgtttaccgtcggtccggtacccggttaaccgtaaggggtacccggggaaacccggaaccggtccctaccccgttacgacccgtagtacccgaacgggtccggaacccgggtaccccgtaaaccgttcgggtaaccggtagggttaccgggtacgttaccgtttaacgtttccgtacggttaccgtaaggtcggtaccggaacccgtaaccgacgttacttggttctaccgggttacggtacggtccggaacggttacctcggtaacccgttacgtacgggtacccacggtacccggtaccggtaaccctaacccgcgtaccggtacctaccgttacccggttacccgtacccttaaccccggcctaccggtacgtaccggg

SEQ ID NO: 272693 - DNA, 634 bp, Homo sapiens
  misc_feature: GYAE6OF02HFPRR.8.87.H10.1.454.CMB.1.raw
  modified_base (456)..(456): a, c, t, g, unknown or other
  misc_feature (456)..(456): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtcggccctgggacaggacggccagaacttactggtggaggagtcaacattgggacttcagatgtgcacgtcggtaccagacaagaacgccaggccacggcccctagtactggtctacttcgttagcgtacttacccgaaccggtccctgtcgggactcccgtgacgcgtattctcgtcgctacgaaggtaccgggaacaccggccctaccgtcgaaccacgtacacggaccgacgggaccctaaccgtggacgtaggacgggtactacttntttcgtgtacgtaaggtcggtacggacctactaactcgttgttacggttcgttacgggcgttacggggaccgtacgttacgaccgttacgtaacgtccgacgaccggtaccggacccaacccgtcgtacgtcctaccgttccgtccggttccccgtcctaccgtccgacccgtaccgg

SEQ ID NO: 272694 - DNA, 760 bp, Homo sapiens
  misc_feature: GYAE6OF02GY1IB.8.87.H10.1.454.CMB.1.raw
  modified_base (217)..(217): a, c, t, g, unknown or other
  misc_feature (217)..(217): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcaggtggccctgggacaggacggccagaattaccngtcggaggagtcaaacattgggacttcgagatgtgctacgtcggtaccagacacgaagccgaggccaggcccctagtacctggtcagtctttagccgtacttccgaaccggtccctcgtcgggactcccgtgacggtcgtattctcgtcggtctaccgtaaacgggtccggggaaaccaccgggacccctaacccgttacgaaccctaacgtaccgaacggaccggaacccggggtaacccctaaacccgttgggaacgtcgggtaacgggttcaacgtttatttaccgtcggttactaaagggtttcggtaacgggaccctaaaccgtaacttaccgtttaggttacggttaccggttacggggaccgttacgggggaacccgtaacgggttaccctaacccgggttacgttaaccggtccggtaccggccccggtaaccggggtaccccctaaacccgtaccggttaacggttaccctaaccgtttccgttaacccgtttacccccgaccccgtttaccgtacccggaaccgtaacccggg

SEQ ID NO: 272695 - DNA, 969 bp, Homo sapiens
  misc_feature: GYAE6OF02HRBBX.8.87.H10.1.454.CMB.1.raw
tcagctcgcgtgtccacgaccggtgctcgatttagcagtactgcgttgggtttgggctgggcctcaggaagcagcatcgggggtgccgcagccatgggcctggaccgctctccttctgagcctccttgctacactttacaggttctgtggcctcctatgaactgacacagccactctcagtgtcagtggccctgggacagacggccagtaacttacctggtggaggactacgaactagttacgggaactttcgaagtacgtggtacgtcgtacgtcggtaaccaaggcgaaggaacggaccgaacgggcccgtaacgggtcccccgttaggtaaccgttcggggttacctaacgttttaccgttttaacgggaccggttaacctttacccccggaaaccccgggtcccccgtttaccggtttacgggggtaacctttccccccggttaggtaaccgggtaccggttaaacgtttacccgttcccggttacggggtacccgttaaccccggttaaaacggggtttaaccccgggggaaaacccgtaacccggggaccccctaaacccccggtttaacggaaaccccgtaacggttaccggaaaccgggtacccggtaaccgggggtaacccccccttaaaacccgggtttacggggaaccggtttacggggtaaacggggttacgttaacgttacgttttacccgttaggttaaccgttaaacgggttcgggtaacccgggtaaaccgtaaacccgtaaacccgttacgttacgggttaccggtttaacccggttccgggggaaccggttacgggggtaacccggtaccggttaaccccggtaacccgttaaccggttaacgtcccgaaccggtaccccggaaccgggtacccctaaaccccggtactccggtaacctacccgttccgttaccgttaccccgaccggtaaccacccgggtagtaacccgg

SEQ ID NO: 272696 - DNA, 769 bp, Homo sapiens
  misc_feature: GYAE6OF02GGAJQ.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtcggccctgggacagacggccaagaacttacctgtggaggagtacaacagttgggacttcagatgtgcactggtacagcagaagccaggccaggcccctgtacgtggtctattacttagcgtacttccgaaccggtccctcgtacgggactcccgtgacgtcgtacttctcgtcggtcctaccgaacggtaccggggaaaccgaccggacccctaaccccgttacgaaaccctacgttaccgaacgtaccggtaacccggggaaccccttaacccggttagggacggttaccgggtaagggttaccggtaactttacgtttaccttaggttaaccgtaaagggttacgggtaccgggtaaccgaaaccgttaaacctaccgtttacggtacggtttaccgggtttccggggtaaaccggtcgggggtaacccggtaaccggggttaccctaaacccggttaacccgtaaacgtcccgtaaccggtccccggaccggggtaaccccaaaccccgtacgttacccgtcctacccgttcgttaccccggttaccccgccccgttacccgtacccgaccgtacccggg

SEQ ID NO: 272697 - DNA, 731 bp, Homo sapiens
  misc_feature: GYAE6OF02GOGXY.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtacaacagttgggacttacagatgtgcagtggtaccagcaagaagccgaggaccaccggccccgtgtacgtggtactactctttagacgtacttacccgaacccggtcccgtccgtcgggactcccgtaggacgcgtacttcgtcgtcggtcctacgaacggtaccgggaacgaccggacccacccgtacgaccacgtccgaacggacgtaacccggggaccccctaaacccggtttgggaacgttacgggtaagggggtacttaactttacgtttttcccggaggtttaaccgaagggtttgggttaccggggaacccttaaccgaacctaacggttttcggttacgttacggttccgggggacggttcggggaaccgtagggttcccaaccggttactaacgtccgaccgtaccccggaccggtaacccccaacccgtactccggtccctaactcccgttttacccggtacccccctacccgttaccccgacggacctaacccgg

SEQ ID NO: 272698 - DNA, 793 bp, Homo sapiens
  misc_feature: GYAE6OF02FXGL7.8.87.H10.1.454.CMB.1.raw
  modified_base (385)..(385): a, c, t, g, unknown or other
  misc_feature (385)..(385): n is a, c, g, or t
tcagctcgcgtgtccacgaccggtgctcgatttagcagtactgcgttggggtttggggctgggcctcaggaagcagcatcgggggtgccgcagccatggcctggaccgctctccttctgagcctccttgctcactttacaggttctgtggcctcctatgaactgacacagccactctcagtgtcagtcggccctgggacagacggccagaacttacgtggtggaggagttacaactagttgggaccttacgagtatgtcgctacgtcggaccagcgaagaacgccgaggccgacggcccctagtaccgtggtcctaagttcgtttacggcctactcccgaacccggtccctgtacgggacctaccggtagacgtcgtactttccncgtacggtacctaccgacggggtacccgggaaccgtaccggacccctacccgtacgaaccctacgtaccgaacggccgaacccgggtacccctaaacccggtttgggacgttccggggttaagggttcttaacccggtttatttccgtacgggttacgtaagggttcgggtaccggaaacccttaacccgtacgttaccggtttgggttccgtttaccgggttccgggtaaacgtccgggggtaaccgtacgggtaccctaccgggttaactacgggtacccgtacccggacccgtaacccgggtacccctaaaccccggtcttacccggtaaccgttaaccggtccccgttttccccggttaacccccgtcccccgttaaccccgttaccggacccggttaacccgg

SEQ ID NO: 272699 - DNA, 714 bp, Homo sapiens
  misc_feature: GYAE6OF02FZWK1.8.87.H10.1.454.CMB.1.raw
  modified_base (381)..(381): a, c, t, g, unknown or other
  misc_feature (381)..(381): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactgtaccagcagaacgccaggccacggccccctgtacgtcggtctatcgtttagcgtacttcccaaccggtccctcgtacgggactcccgtagagtcgtattcctcgtggcctaccgaaggtccggggaacnccgggaccctacccgtagaaccctagtccacggaccgaccgggacccctaaacccggttgggacgttagggacggggttagtaacgttagtttcgtacggttacgtaaaggttcggttacgggtaacctaaccgaaaccgtacgtttacgttcggttaccgtttccggggtaacgttcgggggaacccgtacgggttaccgtaacccggttaccgtaaggtccgaccgtaccccggacggggtaacccccaacccccgttacgtccgttaccgtaacccgtccgttacccggttaaccccctaccccgttccctaccggtacctaaccccggg

SEQ ID NO: 272700 - DNA, 710 bp, Homo sapiens
  misc_feature: GYAE6OF02HZD7O.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcaggtcggccctgggacagacggaccagtaacttacgtggtgggaggagtcaactagttcgggacttcgagtatggtgcacgtggtaaccagacgaagacgccacggcccgacggcccctacggtacgtcggtactacttcgtttacggcgtaactttaccccgaacccggtcccttacggtcgggaccttcccggtgacgtctacttccgtcgtcggacctaccggtaacgggtaccgggaaccaccggccctaaccccgtgacccacgtacgacggaccgacccgggacccctaaccggtggtacgtgggtagggttcaactttgttcgtagttactaaggtcgtacggaaccaaccgtaactacgtttggtacgttccggttacgggacggtacgggaccggtacgttacccacggtaccgttaacgcccgaccggtacccggaccggtaaccccctaacccgtacgtaccggtacctaccgttccgttccgtcccccgttaccccgtccgtacgaccgtaccgg

SEQ ID NO: 272701 - DNA, 709 bp, Homo sapiens
  misc_feature: GYAE6OF02FLALE.8.87.H10.1.454.CMB.1.raw
  modified_base (248)..(248): a, c, t, g, unknown or other
  misc_feature (248)..(248): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctctatgaactgacacagccactctcagtgtcagtggccctgggacaggacggaccagaattaccctggtaggaggagtcaactagttgggaccttanagtatgtacgcactggtaacagacagaacgccgaggccaacggcccctagtacgtggtctattcgttaagcgacgttccaaccggtccctcgtagggtacctcccctaggacgcgtattacctcgtacggaccttaccgaaggtaccgggtaaccggaccggacccacccgtacgaaccactacgacgccgaacgggtacccctaaccccgttgtacgtcggtaagggtacgtacgttaatttacgtcgtcgttaaggtacggtacgggtaaccacccgtaaacttacgttggttacgtacgggttacgggtaaccgtagggtaacccgtacgggttacccgtacccgttacgttaaccgtccgaacggccccgaaccgggtaacccctaacccgaccgttacgtaccgtaccttcccgttaccgttacccccaacccgttcccacgtaccggtaacccgg

SEQ ID NO: 272702 - DNA, 1036 bp, Homo sapiens
  misc_feature: GYAE6OF02F2RWU.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtcggccgtgggacagacggccagaacttaccgtgtggaggagtacaactagttcgggtacttcgagatgtgctacgtacggtaccagacgaaggaacgccgacggcccaacggcccccgtaggtaaccgtggtacctacttacgtttacggccgtaaccttaccccggaaccccggtcccttcggtacgggtacctcccgtaggacgtccgtactttccgtcgtcggtaccgttacccgaagggtccgggggaaaacccgacccggggtacccctaaccccggtaccgaaacccgtaccgttacccggaacggtaccccgggtaacccggggtaacccccttaaaccccgggtttacggggtaaacggttacgggggtaaccggggggtttaaccgttaaaccccggtttaaacggttttaacccggttaccgggtacccgggttaacggggggtaccccggggtttaacgggggaaacccgtaacccggggtacccggtaaaccgggttaccccctttaaaaccggggtttaccggtttacgggggttttttacccggggggtttttaacccggggggaacccgggggtaacccgggggttaaaaccccgtaaaacccgggggttccgtttaaaccccgggggtttaacccccgggttttaccccggttttaacggggttaaccccggaaccccgggttaaaccccgggttaaacccgggggttccccccgtttaacccccgggtaccccccccggtttccggggttaaccccgttacccccgtttacccccggggtttttaacccccgggtttcccccccccggttacccccggttttacccccccggg

SEQ ID NO: 272703 - DNA, 896 bp, Homo sapiens
  misc_feature: GYAE6OF02IUPCI.8.87.H10.1.454.CMB.1.raw
tcagctcgcgtgtccacgaccggtgctcgatttagcagtactgcgttgggtttggggctgggcctcaggaagcagcagtcgggggtgccgcagccatgggcctggaccgctctccttctgagcctcttgctctactttacaggttctggtcggcccttactatcgaactgaacacagccactctcaggttcgtcgaggtcgggacccgtggggaacacgggacggacctaaggtaacctttaccgtgggtagggagggtaactacaacgtagtttacgggaacttcgaggtatgtacgccgtaacgtcgggtaaccagacgaagaaccggccgaacggtcccgaaccgggcccttaggttaaccgtcggttactacgtttaccgtttacggacgttaaccttacccgacccgggtcccgttacggttacgggtacccttcccgtaggacgtaccgtacttcggttacgcggtacccgttaccgggacggtaccgggaaccaccggtaccctaccgtacgaaccctcgtacgccggtaccggtaaccggtaccccgtaaccgttaggaaccggtagggtacggttacgttaactttacggttacgtcggtaaacgtcggtaacgggtaccggaaccgttaaaccgtactacggttacgggttccggtttaccggtaccgggggtaacaccggggttaacccgggtacgggttaccccgtaaccggtttaacgtaaccgggtaccgacccggttaaccccgggtaaaccggtccccccgttaaaacccgggttcgtttaaacccgggtccccgtttaacccgtttaccccgtttaacccggttaccccccgggtttaaaccccggttccccggttaaaccggtacccggtaccccggg

SEQ ID NO: 272704 - DNA, 710 bp, Homo sapiens
  misc_feature: GYAE6OF02GK8HT.8.87.H10.1.454.CMB.1.raw
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
tcagctcgcgtgtccacgaccggtgctcgatttagcagtactgcgttgggtttgggctgggcctcaggaagcagcatcggggtgccgcagccatggcctggaccgctctccttctgagcctccttgactcactttaccaggttcctgtcggcctcctatgaactgacacgagccactctcgagtntcgagtcggccctggacngaccgccagtaactacctgtgggagtagtacaactagttgggtacttcgacgagtggtgccgtaacgtcggtaacaggcaagaacgccaggccacggccccgtagtacgttacggtactacttcgtttacgcgtaacttccgaaccggtcctcgtggtactccgtgacgtcgattcctcgtgtacctacgtaccggtacgggactacgggaccctccgtaacgcgtacgtacgacgaccggacgacccctaaccggttaggtccgtaagggtacggttacaagttttaaccggtctacgggtaacgttaagggtcggttaccgaaaccgtaccgtaaagtccgtttggaaccggttccgttacgggaaccgggttaggacccgggttaacgttccacccggtttactaacgtccgtaccgaccccggtacggtaaccccgacccttacggaccgttctaaccggttccttacccgtaccccaccggtcccgtacgacgtaacccggg

SEQ ID NO: 272705 - DNA, 606 bp, Homo sapiens
  misc_feature: GYAE6OF02F1JXR.8.87.H10.1.454.CMB.1.raw
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggccccctagtactggtctatctttagcgtattaccaaaaccggccctctagggactcccgtagagcgattctctaggctaccgaagtcggggtaacaccggccaccccgtagaccatcacgcaaacgcccaacgcggtagactggacgctagtactattttgtctaggttgtagggactagacagacctaattttagtcgttcgttacggtaccgtcgggaaacctaacgggtcctacccggtccttaacggtaccaccggtaacccaaaccgggaccccaacccccgaacgttcgtaccgtacctccgtcgtttacccccacccttacccg

SEQ ID NO: 272706 - DNA, 674 bp, Homo sapiens
  misc_feature: GYAE6OF02IYR3N.8.87.H10.1.454.CMB.1.raw
  modified_base (212)..(212): a, c, t, g, unknown or other
  misc_feature (212)..(212): n is a, c, g, or t
tcagctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaaatgacacgagccactctcagtgtcagtgcctggacagacgccagattaccgngtggagatcaactagttggacttcagatgtgcactggtacagcagacgccaggccacggccctgtacgtgtcattcttagcgtacttccgaaccggtcctcgtagggacctccgtagacgtcgtacttcctcgtcggtacctaccggaacggtaccgggtaacgacccggtccctaacccgtacgaaccctacgtaccgacgaccggtaccggaaccccctaaccgtttgggacgtcgggtaacggtctaacgtttactttcgagttacgtaaggttcgggacggaaccctaaccgtaacttcgttaggtcggtttaccgtcgggtaaccgtcggggaccgtacggttacccacccggttaacgtagtccgaccgaccggtacccggaccctaacccgtggttcctaccgtcctttccgttacccgttaccccctaccgtcccgttaccgaacccgtaccgg

SEQ ID NO: 272707 - DNA, 1089 bp, Homo sapiens
  misc_feature: GYAE6OF02F0MQM.8.87.H10.1.454.CMB.1.raw
tcagctcgcgtgtccacgaccggtgctcgatttagcagtactgcgttgggtttgggctgggcctcaggaagtcagcatcggggtgccgcagccatggctggaccgctctccttctgagctccttgctcactttacaggttctgtggcctcctatgaactgacacagccactcgtcagtcgtcaggtcggcccttgggacacggacgggtcccaaggtaacttcccgtaggtcgggaggtaccggttcaaacgtacgtttcgggaaccttttacgaaggttaacgttgggttacggtacgtaccgtttaggggttaaacccgtaacggtccggaaaggtaaaacgttcccccggtaaacggggtaccccgaaacggggtcccccccgtttaacgggtaacccggtttacggttaccggtaaccgttaaccgtttttaccgggtaccggttaaacgtttccccgtaaaaacccggggttcccccgttaaccggttacgggggtaaccttttacccccgggttacggaacggtacggttaaccgtttacccgtttccggttaacgggcccgtttaacccgtaaaaccgggggtttaacccggggggaaaaccggtaacccgggggtaaccccgtaaccccggtttacgggaaacccccgttaaggtttacccgtaaccgggtaacccggaaccggggttaacccccctaaaaccccggggttttacggggaaaaccgtttcggggtaaccgggggttaaccgtaaccggggttttaattttacccggtttaaccgggttacggttaaaccgggtttaccgggtttaaacgggggaacccctaaaacccgtaaacccggtttaaaccggttttccgggtttaccgggttaccggtttaaacccgggggtaaccggttacgggggtaacccggttaccgggtacccgttaacccgtacccgggtttaaccggttacgacccggtaccccgtaacgggtaacccccgtaccccgtaacgtccggttaaccctaaccgtcccgtttaccggtaacccccgtaccctttacccccggtagttacccccggaacccgg

SEQ ID NO: 272708 - DNA, 490 bp, Homo sapiens
  misc_feature: GYAE6OF01DSLMN.47.76.G10.1.454.CMB.1.raw
  modified_base (302)..(302): a, c, t, g, unknown or other
  misc_feature (302)..(302): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacngggccactggcatcccagccaggttcagtggcagtgagtctgggacagacttcactctcaccatcagcagcctagagcctgaagattttgctactttattactgtcagcagcgtagcaactggcctctctactttcggcggaggaccgagggtgagagtcgagacgaactgtgcgtgcacatctgtcc

SEQ ID NO: 272709 - DNA, 539 bp, Homo sapiens
  misc_feature: GYAE6OF01C3C30.47.76.G10.1.454.CMB.1.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggaccaggctcccaggctcctcatctatgatgcatccaanaggccactggcatcccagccaggttcagtggcagtgagtctgggacagacttcactctcacatcagcagcctagacgcctagaagtatttagcttactttatactgtcagtcagcgtagctaacgtcggccttctctacgtttcgggacggacgggaccgtaggggtggagtacgtacgaaggacggtaacgttgggtacggccgttacggaccctaccgtacttcgttcgttacccg

SEQ ID NO: 272710 - DNA, 506 bp, Homo sapiens
  misc_feature: GYAE6OF01BMXBZ.47.76.G10.1.454.CMB.1.raw
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggaccaggcctcccaggcctcctcatctatgatgcatccaacngggccactggcatccccagccaggttcagtggcagtgagtcgngggacagcttcactctcaccntcagcagcctagacgcctagaagtatttcgacttactttattactgtacagcagcgtagcaacgtcgcctctcctacgtttcgggcggagggccgtagggtggagagtcgagacgacgtggngctgacacntctgtc

SEQ ID NO: 272711 - DNA, 532 bp, Homo sapiens
  misc_feature: GYAE6OF01C1ZYY.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagccaccctgtctttgtctccaggggaaanagccacctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagactcactctcaccatcagcagccctagacgcctaggaacgtactttaggacttttattactgtcagcagtcgtgagttctcggtccctccggtcttcgtacgtttcgggacgggtagggacccgagggtcggactagtaggaaaccgtatggtggctgctaccattccttgtccttcgtacg

SEQ ID NO: 272712 - DNA, 518 bp, Homo sapiens
  misc_feature: GYAE6OF01EISIQ.47.76.G10.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
  modified_base (435)..(435): a, c, t, g, unknown or other
  misc_feature (435)..(435): n is a, c, g, or t
  modified_base (497)..(497): a, c, t, g, unknown or other
  misc_feature (497)..(497): n is a, c, g, or t
  modified_base (510)..(510): a, c, t, g, unknown or other
  misc_feature (510)..(510): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaanagccaccctctcctgcagggccagtcagagtgttggcagctacttagcctggtaccaacagaaacctggccaggcctcccaggcctcctcatctatgatgcatccaacgnggccacgtggacatccccagccctaggttcaggtgcaggtgagtcgtagggacagtactcactctcacatcagcagcctagacgacctagaagtatttacgactactttatactgtcagtcagtcgtanacaacgtcgcctctactacgttcggcggtacggccgtagggtgaagcgtacgagacagtcgnggctggaccacgntcgtgtcc

SEQ ID NO: 272713 - DNA, 492 bp, Homo sapiens
  misc_feature: GYAE6OF01ENB0U.47.76.G10.1.454.CMB.1.raw
  modified_base (302)..(302): a, c, t, g, unknown or other
  misc_feature (302)..(302): n is a, c, g, or t
  modified_base (486)..(486): a, c, t, g, unknown or other
  misc_feature (486)..(486): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacngggccactggcatcccagccaggttcagtggcagtgagtctgggacagacttcactctcaccatcagcagcctagacgcctagaagtatttgactactttattactgtcagcagcgtagcaactgcctctctactttcggcggagggaccgagggtggagagtcagacgacgtgtggctgcacntctgtc

SEQ ID NO: 272714 - DNA, 561 bp, Homo sapiens
  misc_feature: GYAE6OF01B94KL.47.76.G10.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (369)..(369): a, c, t, g, unknown or other
  misc_feature (369)..(369): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctggcagggccagtcagagtgttggcagctacttagcctggtaccaanagaaacctggccaggctcccgaggctcctcatctatgatgcatccaacgagggcccacgtggccactcccagccaggttcaggtggcagtgagtcgtgggacagacttcactcncacctatcagcacgcctagacgcctagaacgtattttcgacttactttattactgtacagcagcgtagcaacgtcggccttcgtcctacgtttcgggacggtaacgggtaccgtaggggtcggaagtacgtacgaaggaccggtaacgttgggtcggaccgtcggaccctaccgtagttccgtcggttaccc

SEQ ID NO: 272715 - DNA, 515 bp, Homo sapiens
  misc_feature: GYAE6OF01AXYDX.47.76.G10.1.454.CMB.1.raw
  modified_base (195)..(195): a, c, t, g, unknown or other
  misc_feature (195)..(195): n is a, c, g, or t
  modified_base (506)..(506): a, c, t, g, unknown or other
  misc_feature (506)..(506): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctcccaggctcctcatctatgatgcatccaacagggccactggcatcccagccaggttcagtgcagtgagtctgggacagacttcactctcaccatcagcagcctagacgcctagaagtattttgactactttattactgtcagcagcgtagctaactcggcctctctacgtttcgggcggacgggaccgaggggtggaggtagtcgaggacggtaacgtggtggcgtggaccaccntcgtgttcc

SEQ ID NO: 272716 - DNA, 517 bp, Homo sapiens
  misc_feature: GYAE6OF01CRJ9C.47.76.G10.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagngtgttggcagctacttagcctggtaccaacagaaacctggccaggctcccaggcctcctcatctatgatgcatccaacgngggccactggcactcccagccaggttcagtggcaggtgagtcgtgggacagacttcactcncaccatcagcagcctagagccgtagaagtatttacgcttactttatttactgtcagcagcgtagctaactcggtcctctctacgttcggcggacgggaccgagggtggagacgtcgaagacggacgtgtggcgtcgacaccactcgtgttcc

SEQ ID NO: 272717 - DNA, 596 bp, Homo sapiens
  misc_feature: GYAE6OF01AYEFW.47.76.G10.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgactacagtctccagtccacctgtctttgtctccgaggggaangccacccgtctcctgcgagggccagtcagaatacttcactcctacttagcctggtaccaacagaacctggtcaggctccgagctcctnatctagtgatgcatccaacngggccacgtgggacactcccagacctaggttcaaggtggacaggtgggtactaggggaacaggtacttcgacgtctacacgatcgagtcacgcctagacnccgtagaacgtacgtttggaactttagttacgtgtcaagtcagtcgtagtacgttcgtcggtacctccggtcttaccgtacgtttccgggacgggtacgggacccgtaggggttcggactacgtacgaaacggtacgtagggtacggcgtcgaccctaacgtacttccgtcgtttcctttcgacgttccccg

SEQ ID NO: 272718 - DNA, 564 bp, Homo sapiens
  misc_feature: GYAE6OF01BL5KW.47.76.G10.1.454.CMB.1.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (437)..(437): a, c, t, g, unknown or other
  misc_feature (437)..(437): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaagngccaccctctcctgcagggccagtcagaatattcactcctacttagcctggtaccaacagaaacctggtcaggctccaggctctcatctatgatgcatccaagngggccacgtggcatcccagacaggttcagtgcagtggtctgggacngacttcactctcaccatcagcagcctagacgcctagtaagtactttagggtacttttacttacgtgtacagcctagccgttgacgttcgnggcctcgctctacgtttcgggcggtacgggtaccgtaggggtggaagtacgtaaccgaaacgggtacgtagggtacggtaccaggtacccaaccgtcgttaccgttgttacttcctacgtttccccg

SEQ ID NO: 272719 - DNA, 514 bp, Homo sapiens
  misc_feature: GYAE6OF01CCJO0.47.76.G10.1.454.CMB.1.raw
  modified_base (195)..(195): a, c, t, g, unknown or other
  misc_feature (195)..(195): n is a, c, g, or t
  modified_base (508)..(508): a, c, t, g, unknown or other
  misc_feature (508)..(508): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggctcccaggctcctcatctatgatgcatccaacagggccactggcatcccagccaggttcagtggcaggtgggtctgggacagacttcactctcacatcagcagcctagacgcctagaagtatttgactagtttattactgtcagactaacgtaatactgcctccgctctacgtttcggcggtacgggacgagggtggacagtagaaacgtacgtggacggctgcacgtatctgtcttcgnttcccg

SEQ ID NO: 272720 - DNA, 271 bp, Homo sapiens
  misc_feature: GYAE6OF01BAWIK.47.76.G10.1.454.CMB.1.raw
  modified_base (256)..(271): a, c, t, g, unknown or other
  misc_feature (256)..(271): n is a, c, g, or t
tcagagctcacgtacacgaccggtgctcgatttagtcactcatacaggggcagttccagacttcactctcaccatcagcagcctagagccctgaagattttcgcactttattactgtcagcagcgtagcaactggcctctcactttcggcggagggaccagggtcggagatcagacgaactgtggctgcaccatctgtcttcatcttcccgcatctgatacgtgagctctgagcgggcttggccaaggcgcatagnnnnnnnnnnnnnnnn

SEQ ID NO: 272721 - DNA, 256 bp, Homo sapiens
  misc_feature: GYAE6OF01A7FWU.47.76.G10.1.454.CMB.1.raw
  modified_base (252)..(256): a, c, t, g, unknown or other
  misc_feature (252)..(256): n is a, c, g, or t
tcagagctcacgtacacgaccggtgctcgatttagtcactcatacaggggcagttccagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctgatacgtgagctctgagcgggctggcaaggcgcatagnnnnn

SEQ ID NO: 272722 - DNA, 615 bp, Homo sapiens
  misc_feature: GYAE6OF01BLPZ8.47.76.G10.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagactattgttttgacacagtctccagccaccctgtctttgtctccgaggggaangccaccctctcctgcagggccagtcagagtgttggcagctacttagcctggtaccaanagaaacctggccaggctccaggctcctnatctatgatgcatccaacgagggccacgtggcatcccagcctaggttcagtggcaggtgagtcgtgggacagtacttcactctacaccatcagcagcctagacgcctagaagtatttgactacttttattacgtgtaccagtcgagtcgtagacctaacgtcggtacccttcgttccgtaaccgtttccggggacgggtaacggggtacccgtagggggttacgggaaggtacgttaccggaagggtaaccggttaaaccggttcggggttacgggtaccgttacgggtaaccccgtaaacccgttaacgttcccggtttaacgttttccccg

SEQ ID NO: 272723 - DNA, 498 bp, Homo sapiens
  misc_feature: GYAE6OF01AZ5G3.47.76.G10.1.454.CMB.1.raw
  modified_base (495)..(495): a, c, t, g, unknown or other
  misc_feature (495)..(495): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagtactttggacttttatactgtcagcagcgtgagttctggcctccgctcactttcggcggagggacccaggggtgagatcgaaacgatggtggctgcaccatctgtcttntac

SEQ ID NO: 272724 - DNA, 516 bp, Homo sapiens
  misc_feature: GYAE6OF01ETJJO.47.76.G10.1.454.CMB.1.raw
  modified_base (305)..(305): a, c, t, g, unknown or other
  misc_feature (305)..(305): n is a, c, g, or t
  modified_base (393)..(393): a, c, t, g, unknown or other
  misc_feature (393)..(393): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaagagccaccctctcctgcagggccagtcagagtgttggcagctacttagcctggtaccaacagaaacctggtcaggcctcccaggctcctcatctatgatgcatccaacgngggccacgtggcatcccagacaggttcaggtgctaggtgggtctagggacagtaccttcgactctacacctatccagcagcctagacncctagaagtatttgctactttattactgtacagtcgagtcgtagcaacgtcggccttctcgtacgttcgggacggacggaccgagggtgagatcgagtacgagtggtgctgcacatctgtctc

SEQ ID NO: 272725 - DNA, 609 bp, Homo sapiens
  misc_feature: GYAE6OF01BWUZ4.47.76.G10.1.454.CMB.1.raw
  modified_base (196)..(196): a, c, t, g, unknown or other
  misc_feature (196)..(196): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcagggccagtcagagtgttgacagctacttagtctggtaccaagagaaacctggccaggcctcccgaggcctcctcacgtcgtgggatcggactactacccgaacgacggggcccgcgtacggccaactccccgaggccctagggttccaggttcggcgtaggttcggggtcgtggggacaggtcttcacgtcctacacctatccgagcacgcctagacgccgtagaacgtatttgacttagtttattacgtgtcagtactaacgtacactacgtcgcctactcgtaccgtttcggacggtacggaccgagggtacggacggtacgtacggaacggtacgtaacgtggtacggtcgtcgaccgtacccgtactccgttaggttccttcgtcgttccccg

SEQ ID NO: 272726 - DNA, 534 bp, Homo sapiens
  misc_feature: GYAE6OF01CYQZ2.47.76.G10.1.454.CMB.1.raw
  modified_base (343)..(343): a, c, t, g, unknown or other
  misc_feature (343)..(343): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggcctcctcatctatgatgcatccaacagggccactggcatcccagccaggttcagtgcagtgagtcngggacagacttcactctcacatcagcacgcctagacgcctagaagtatttcgctactttattactgtcagcagcgtagacaacgtcggccttctctacgtttccgggacggtacgggaccgtaggggtcggagacgtacgaaggtaaccgaacgttggtcggcgttacggacctaccattcgttcgttccg

SEQ ID NO: 272727 - DNA, 661 bp, Homo sapiens
  misc_feature: GYAE6OF01BBR6X.47.76.G10.1.454.CMB.1.raw
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
  modified_base (417)..(417): a, c, t, g, unknown or other
  misc_feature (417)..(417): n is a, c, g, or t
tcagagctcacgtacacgaccggtgctcgatttagtcactcatacagggggagggaactgctcagttaggacccagagggaaccacggaagccccagctcagcttctcttcctcctgctactctggctcccagacttccaccggagacattgttttagacacagtctccagccaccctgtctttgtctccgagggaangccacctctccgtgcaggccagtcagagtgtggcagctacttagcctggaccaanagaaacctggaccaggcctcccgaggctcctcatctatgatcgccatcccgaacgacgggccacgtcggacacgtccccgagtcccgaggttccaggtggccgtaggtcgggtctgggactaggtcgttcacgtctacgacctatcaacgtcaacgtccctaanacggttctaggtaagttacgttttgaccttaaagttttctaacgttgtaccgtagtacgtaagttactacgaacttaacgcgtaacccgtctaacccgtaccgtttaccgggaccgtaaacggggtacctaaccggtaacgttcggggaaacgttaaacgtttaaaccgggaccgttaggtacggtaaccgttcgaacccttaacgttacgttcttacggttcccttccgtacgtttacccccg

SEQ ID NO: 272728 - DNA, 583 bp, Homo sapiens
  misc_feature: GYAE6OF01C9K7H.47.76.G10.1.454.CMB.1.raw
  modified_base (382)..(382): a, c, t, g, unknown or other
  misc_feature (382)..(382): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacgagggcccacgtggcaactccccaagaccaggttcaggtggcaggtgggtctaggggacaggacttcactctcacatcaancacgctagcgctagaagttcgttagttaactttactagtcgtactagcgtagtcgtgtagttcgtcggtacctccgtcttaccgtacggtttccgggacgggtaacgggaccggtaggggtacgagtaacgtaaccgaaacgtacggtggtcggcgtacgaccgtacgtacgttcgttcgttacttccgtcgttacccccg

SEQ ID NO: 272729 - DNA, 552 bp, Homo sapiens
  misc_feature: GYAE6OF01CU8ZV.47.76.G10.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcagggccagtcagagtgttggcagctacttagcctggtaccaacagaaacctggccaggcctcccaggcctcctcatctatgatgacatccaacgngggccacgtggcactcccagacaggttcagtggcaggtgggtctgggacagtacttcactcctacacctatcagcacgtcctagacgtacctagaacgtacgtttggtaactttagttactgtcagtctagtcgtgtacgttcgtcggtcctccgtctcgtacgttcgggcggtacggacgagggtgagtacgtacgaaacggtactggtcgcgtgacctaccgtattccgtgttccttcgtaccg

SEQ ID NO: 272730 - DNA, 545 bp, Homo sapiens
  misc_feature: GYAE6OF01C2NUD.47.76.G10.1.454.CMB.1.raw
  modified_base (194)..(194): a, c, t, g, unknown or other
  misc_feature (194)..(194): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccacctgtctttgtctccaggggaaangccaccctctcctgcagggccagtcagagtgttggcagctacttagcctggtaccaacagaaacctggaccaggcctcccaggcctcctcatctatgatgcatccaagcggccatggcactcccagccaggttcaggtggcagtgagtcgtgggacagacttcactcacacatcagcacgctagacgtcctagtaagtatttgacttactttattactgtacagtcagtcgtagactaacgtcggtcctctcgtacgtttcgggacggtacgggacgtagggtggaagtacgtacgaaggaacggtaacgttggtacggcgttacggactaccgtacgtcgttgttacccg

SEQ ID NO: 272731 - DNA, 764 bp, Homo sapiens
  misc_feature: GYAE6OF01EHD38.47.76.G10.1.454.CMB.1.raw
  modified_base (201)..(201): a, c, t, g, unknown or other
  misc_feature (201)..(201): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagactatttgttttgacacagtctccagccaccctgtctttgtctccgaaggggaaagngcccaccctctcctgcgacgggccagtcagtagtgtggcagctacttagcctaggtaaccaacagaaacctggtacacgggcctaccgaggtcctcctcatctatgatgactactaccgaacgacgggcccacgtcggacctactccccgaaggaccgtagggttcaggttcgggacgtagggttcggggtacgtaggggaacctacggtacctttcgaacctttccgtaccaaccgtatccgaacggtaccgtaacgtacccgtaacggtaaccggtacccgttaagggttaaacgtttacgttttacggtaaccttttaacgtttttaacgtttaaccgtttcgtaaccgtacggtaccgtacggttaccggtaacgtaccgtaaccgttcgggtacccttacgttaccgttaccggtttccggggaccggggtacggggtaaccgggtacggggtacgggtacggtaacgtaccggtaaacggtaaccgggtaacggttgggttaccgggtacgtaccggtacctaacccgtacgtttaccggttccgttccgttacccg

SEQ ID NO: 272732 - DNA, 574 bp, Homo sapiens
  misc_feature: GYAE6OF01CA96Q.47.76.G10.1.454.CMB.1.raw
  modified_base (196)..(196): a, c, t, g, unknown or other
  misc_feature (196)..(196): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccactggagaaatagagatgacgcagtctccagccaccctgtctgtgtctccgaggggaaangcccaccctctcctgcagggccagtcagagtatagcagcaacttgcctggtaccagcaagaacctgggcaggctcccaggctcctcatctatcgatgcactccaacgagggccactggcactcccagaccaggttcagtggcgtaggtcgggtctgggacagtacttcactctacacctatcagcagcctagacgtcctagaagtatttgactaacttattactagtaactaaaatactaaccgtagtccgaccccgtctacctacgttaccggacgggtaacgggtaaccgtaagggtcggtaacgacgtaccgaaaacggtactacgggtacggtaccttacggaccgtaaccctagtttccgtggttccttaccg

SEQ ID NO: 272733 - DNA, 496 bp, Homo sapiens
  misc_feature: GYAE6OF01A6HP3.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccggccaccctgtctttgtctccaggggaaanagccaccctctcctgcagggccagtcagagtgttggcagctacttagcctggtaccaacagaaacctggccaggctcccaggctcctcatctatgatgcatccaacagggccactggcactcccagccaggttcagtggcaggtgagtcgtgggacagcttcactctcaccatcagcagcctagacgcctagaagtatttgactactttattactgtcagcagtcgtagcaacgtgcctctctacgtttcggcggacggcgagggtgagatcgagacgacgtgcgctgcacatctgtcttc

SEQ ID NO: 272734 - DNA, 643 bp, Homo sapiens
  misc_feature: GYAE6OF01BLS5V.47.76.G10.1.454.CMB.1.raw
  modified_base (193)..(193): a, c, t, g, unknown or other
  misc_feature (193)..(193): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccacctgtctttgtctcgagggaagngccaccctctcctgcgagggccagtcagagtgttggcagctacttagcctaggtaccaacagaaacctggaccaggcctacccgaggtcctcctcatcctatgatcgacactacccgaacgacgggcccaacgtggaccacgtccccaaggtaccgtaagggtttccaggttcggactagggtcgggtcgtacggggaactaggtacctttcaaccttcgtaccgaacctagtcagcctaacgtcccgtaaggtacgaccgttaaggaaacgttacgttttaggtaaccttttaagttaccgtgttaccagtccgtaggtacgttgtacgttcgccggtcctcccgtactccgtaccgtttcgggaccggtacggccgtagggtcgacgtacgtacgaaacgtagtggtcggtccgtacgaccgtactcgttcgttcgttctcgtacccg

SEQ ID NO: 272735 - DNA, 509 bp, Homo sapiens
  misc_feature: GYAE6OF01B7CLN.47.76.G10.1.454.CMB.1.raw
  modified_base (195)..(195): a, c, t, g, unknown or other
  misc_feature (195)..(195): n is a, c, g, or t
  modified_base (500)..(500): a, c, t, g, unknown or other
  misc_feature (500)..(500): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagatttcaccggagacattgttttgacacagtctccagccaccctgtctttgtctccaggggaaanagccaccctctcctgcagggccagtcagagtgttggcagctacttagcctggtaccaacagaaacctggccaggcctcccaggctcctcatctatgatgcatccaacgagggccacgtggcatcccagccaggttcagtgcagtgagtcgtgggacagacttcactctcacatcagcacgcctagacgctagaagtatttgactactttattactgtcagtcagcgtagctaacgtcggcctctctacgtttcggcggacggaccgagggtggagagtcgaagacgtacgtgtggctcgacactntcgtgttcc

SEQ ID NO: 272736 - DNA, 646 bp, Homo sapiens
  misc_feature: GYAE6OF01CEHX2.47.76.G10.1.454.CMB.1.raw
  modified_base (192)..(192): a, c, t, g, unknown or other
  misc_feature (192)..(192): n is a, c, g, or t
  modified_base (249)..(249): a, c, t, g, unknown or other
  misc_feature (249)..(249): n is a, c, g, or t
tcagagctcacgtacacgaccggtgctcgatttagtcactcatacagggggaggaactgctcagttaggacccagagggaaccatggaagccccagctcagcttctcttcctctgctactctggctcccagattccaccggagactattgtttgacacagtctccagccacctgtcttgtctcgagggaaangccacctctcctgcagggccagtcagagtgtggcagctacttagcctaggaaccaanagaaaccgtggccaaggcctaccgaggtcctcctcatctaatgatagcactaccaaacgacgggacccaagtcggcaacgtcccaggacctagggttaccaggtcggacaggtgaacggtcgtagggaacagtactctactctacaccatcagacacgactacgagacctagtaaacgtagtttacgacttaacttttaacgttaacgtacgtacgtaacgtcgtaaggtaccgtaacgtacgaacgttcggtacccttcgttacccgttacggttttaccgggaccggggtaacggggtaccgtaagggggttacgggaagtacggtaacgaagggtaaccggtaaagttcgggtaggttaccgcggaactaaccgtaacttcgttcggtttaccc

SEQ ID NO: 272737 - DNA, 591 bp, Homo sapiens
  misc_feature: GYAE6OF01DM6W8.47.76.G10.1.454.CMB.1.raw
  modified_base (197)..(197): a, c, t, g, unknown or other
  misc_feature (197)..(197): n is a, c, g, or t
  modified_base (385)..(385): a, c, t, g, unknown or other
  misc_feature (385)..(385): n is a, c, g, or t
  modified_base (580)..(580): a, c, t, g, unknown or other
  misc_feature (580)..(580): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcagggccagtcagagtgttggcagctactagcctggtacacagaacctgccaggctccaggcctcctcatctatgatgcactccaacgcgggccaacgtggaccactccccgagaccccgtagggttaccaggtcggcagtcggagtcgtagggacagtacttcactcacactntcacgcacgcctagacgtcctaggtaaacttagtttcgacttaacttttactttacgtcgtactacggtactaggtacccgttaagtaccgtaaccgtcgtacccttcttaccgttacggtttcggggacggaacgggtacgtggggtaggaacgtcgtacgaggaactacggttcggtacggctacgctacgtnttcgtcgttcc

SEQ ID NO: 272738 - DNA, 621 bp, Homo sapiens
  misc_feature: GYAE6OF01DG9G9.47.76.G10.1.454.CMB.1.raw
  modified_base (197)..(197): a, c, t, g, unknown or other
  misc_feature (197)..(197): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagaagttgtgttgacacagtctccagccaccctgtctttgtctccgaaggggaaangcccaccctctcctgcagggccagtcagaatattcactcctacttagcctggtaccaacagaaacctggtcaggctcccaggctcctcatctatgatgcatccaacagggccactggcatcccagacagttcagtgcagtgggtctgggacagacttcactctcacatcagcacgcctagacgcctagaacgtacgttttggtaacttttacttacgttgtacgtagctaggtcgtagtacgttcgttcggcccttcccgcctttccgtaccgttttccgggaccgggtaacggggtacccgtaagggggttacgggaacgtaacgttaccgaaaaaccggtaaccggttagggtacgggtcccgttacggaccctaacccgtacgttcccttaggtttaccccttccgtaaccgtttcccccg

SEQ ID NO: 272739 - DNA, 507 bp, Homo sapiens
  misc_feature: GYAE6OF01CU8LR.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggctcccaggcctcctcatctatgatgcatccaacagggcccactggcatcccagccaggttcagtgcagtgagtctgggacagacttcactctcacatcagcagcctagacgcctagaagtatttgactactttattactgtcagcagcgtagctaactcggcctctctacgtttcggcggtacggacgagggtaggagagtcgagacggaacgtggtggcgtcgacacactctgttccg

SEQ ID NO: 272740 - DNA, 513 bp, Homo sapiens
  misc_feature: GYAE6OF01CYURP.47.76.G10.1.454.CMB.1.raw
  modified_base (195)..(195): a, c, t, g, unknown or other
  misc_feature (195)..(195): n is a, c, g, or t
  modified_base (348)..(348): a, c, t, g, unknown or other
  misc_feature (348)..(348): n is a, c, g, or t
  modified_base (510)..(510): a, c, t, g, unknown or other
  misc_feature (510)..(510): n is a, c, g, or t
tcagagctcacgtacacgaccggtgctcgatttagtcactcatacaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatcctcctgtagggccggtcagagtattagcatcaacttagcctggtaccagcagagacctgggcaggctcccaggctcctcatctatgatgcgtccaccgagggccactggccatcccagacaggttcaggtggcagtgcgtcgngggacaggtagttcacttctcaccatcaacacgcctgcagtctagaagtattttgcttagtttattacctgtacagcagtatctataactcggccgtctcacccgttcggaccgaagggaccacgacgtggagtataaacgtacgtgtggctagccaccgtntcg

SEQ ID NO: 272741 - DNA, 505 bp, Homo sapiens
  misc_feature: GYAE6OF01AXCXN.47.76.G10.1.454.CMB.1.raw
  modified_base (195)..(195): a, c, t, g, unknown or other
  misc_feature (195)..(195): n is a, c, g, or t
  modified_base (351)..(351): a, c, t, g, unknown or other
  misc_feature (351)..(351): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctcccaggcctcctcatctatgatgcatccaacagggccacgtggcatcccagccaggttcagtggcaggtggtctgggacngacttcactctcacatcagcagcctagagccgtagaagtactttggtactttatactgtcagcagcgtgagttcgtgcctccgctctacgtttcggcggacggacgagggtgagtatacgaaacgactggtcggctgacacatctcgtctctac

SEQ ID NO: 272742 - DNA, 701 bp, Homo sapiens
  misc_feature: GYAE6OF01CIJH2.47.76.G10.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagactattgttttgacacagtctccagcccacccttgttctttgtcctccgaaggggaaancgcccaccctctccngcgagggccagtcagagtgttggcagctacttagcctacggtaaccaacgacgaaaccgtgggaccaggcctacccgaggtcctcctcatctatgatgacactaccaacgacgggccctaacgtcggacctaacgtcccccgagacccgtagggttaccagggttccggacgtaggggttcggggttacggacggggaactcgggttaccttaccgaccttactacccgacctagtaccgacgcctaacggtaccgtaagaccgtaccgttaggtaaacgttagttttcggactttaggtttacttacgttacgtactaacggtaaccttaaacgttaaactacggtccggtcctaccgtacgttaccgtaccggtttccgggacgggtaaccgggtacggacgggtacgaacgtacgtaaggaaaccgtacggttcggtacgtccgcgacctacgtacgttcgtacgttcctctcgttcccg

SEQ ID NO: 272743 - DNA, 600 bp, Homo sapiens
  misc_feature: GYAE6OF01C166O.47.76.G10.1.454.CMB.1.raw
  modified_base (197)..(197): a, c, t, g, unknown or other
  misc_feature (197)..(197): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagcccacctgtctttgctaccgaaggggaaanacgcccaccctctcctgcacgggccagtcagaatatcactctacttagcctggaaccaacagaacctggcaggcctccgagcctcctcatctatgatgcactccaaacgcgggcccagtcggacactccccaagtaccgagggttcaggtcggactagggttggggtcctaggggaacagtacttcactctccactatcacgcacgaccgtaaggcgccgtaaggtaacttacgtttaggtaacttttagtacgtgtacagcaggtcgtgtacgttcgtcggtccctccgtcttaccgtacggttcgggacgggacgggacgtaggggtcgaagtacgtaaccggaaacggtacgttgggcggtcctcgaccctaactcgttccgtcgttcctacgttacccg

SEQ ID NO: 272744 - DNA, 542 bp, Homo sapiens
  misc_feature: GYAE6OF01B14KB.47.76.G10.1.454.CMB.1.raw
  modified_base (194)..(194): a, c, t, g, unknown or other
  misc_feature (194)..(194): n is a, c, g, or t
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
tcagagctcacgtacacgaccggtgctcgatttagtcactcatacaggggaggaactgctcagttaggacccagagggaaccatggaagcccagctcagcttctcttcctcctgctactctggctcccagattccaccggagacattgttttgacacagtctccagccaccctgtctttgtctccaggggaaangccaccctctcctgcagggccagtcagagtgttggcagctactagcctggtaccaacagaaaccctggacccaggcctccgaggcctcctcatctatgatgcatccaagnggccatggcatcccagccaggttcagtggcaggtnagtcngggacagcttcactctcaccatcagcacgcctagacgcctagtaacgtattttagcttaacgttttattactgtacagcgtagcgtagcaacgttcggaccttctactacgttcgggcggagggtccgagggtggacgtagtacgtaaggacgtaacgtcggtaggtcctaggtaccaccgtacgttcgtcggttacc

SEQ ID NO: 272745 - DNA, 575 bp, Homo sapiens
  misc_feature: GYAE6OF01CM8MC.47.76.G10.1.454.CMB.1.raw
  modified_base (195)..(195): a, c, t, g, unknown or other
  misc_feature (195)..(195): n is a, c, g, or t
  modified_base (377)..(377): a, c, t, g, unknown or other
  misc_feature (377)..(377): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccaggcctcctcatctatgatgcatcccaacgacgggcccacgtggaccactccccgagcccgtaggttcaggtcggcaggtgagtctgggacagacttcactcncaccatcagcagcctagacgcctagtaagtagtttacgacttactttattactgtacagtcacgtcgtacgctaacgtcgtcccttcgttaccgtacgtttccgggcgggtaacgggaccggtaggggtacggaaggtacgtacgaaggtaacggtaacgtcggtcggacgtcggacccaccgtacttcgttcgttcc

SEQ ID NO: 272746 - DNA, 602 bp, Homo sapiens
  misc_feature: GYAE6OF01DL4LG.47.76.G10.1.454.CMB.1.raw
  modified_base (194)..(194): a, c, t, g, unknown or other
  misc_feature (194)..(194): n is a, c, g, or t
  modified_base (394)..(394): a, c, t, g, unknown or other
  misc_feature (394)..(394): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtcttgtctccgaggggaanagccacctctctgcaggccagtcagagtgttggcagctacttagcctaggtaccaacagaaacctggaccaggcctaccgaggcctcctcatctatgatcgacatacccaacgcggccaagtcgcacgtcccagccgtaggttcagtcggactaggtgaacgttccgtagggaccaggtaccttcgactcctacgaaccntacacgtaccacgacccgttagacgtccctaaggaaacgtttacgtttacgactttaacgttttacgttacgtcgttaccaggtaccgtaggtacgtaacgcctaacggtcggcccttacgtctacggtttcgggacggtacggacgtgggcggagtacgacgacggacgacgttggacgcgtacgtaccacgtcttcgtcgttaccg

SEQ ID NO: 272747 - DNA, 558 bp, Homo sapiens
  misc_feature: GYAE6OF01CZ1CB.47.76.G10.1.454.CMB.1.raw
  modified_base (403)..(403): a, c, t, g, unknown or other
  misc_feature (403)..(403): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccaggggaaagagcccaccctctcctgcagggccagtcagagtgttggcagctacttagcctaggtaccaacagaaacctggccaggctcccaggcctcctcatctatgatgcatccaacgagggcccagtggcactccccagccaggttcaggtggcagtgagtcgtgggacaggacttcgactctcaccatcagcagcctagacgcctagtaagtnttttagacgttacttttattacttcgtctagtcagtcgtacgactaaccgtcggtccttcgttccgtacgttttccgggacgggtacgggtaccgaggggtggagtagtcgaagacggtaactggtaggcgtcggactacctacgtcgtgtaccg

SEQ ID NO: 272748 - DNA, 638 bp, Homo sapiens
  misc_feature: GYAE6OF01BOOP3.47.76.G10.1.454.CMB.1.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccacctgtctttgtctccgaggggaaancgcccaccctctcctgcgacgggccagtcagaatatcactctacttagcctggtaccaanagaacctggtcaggcctccgaggcctcctacatctatgatcgcactaccgaaacgacgggcccacgtcggccacgtcccgagacctagggttcaggtcggacgtaggtcggtcgtaggggactacggtaccttcacctcgtacaccatccagcacgtccgtagacgtaccgtaggtaagttcgtttacgacttaacttttacttaaccgtgttaacgagtcgtaaggtcgttagtacggtttcgtcggtaccccgttccgtcgttacccgttaccggtttcggggacggtacggggaccgtaggggtagaacgtaacgtacggaaacgtaggtcggtcggtacgtccgaccgtacctacgttcgtacgttcttccgttaccg

SEQ ID NO: 272749 - DNA, 881 bp, Homo sapiens
  misc_feature: GYAE6OF01B61MB.47.76.G10.1.454.CMB.1.raw
  modified_base (197)..(197): a, c, t, g, unknown or other
  misc_feature (197)..(197): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccaccctgtctttgtctccgaggggaaancgccaccctctcctgcgagggccagtcagagtgttggcagctacttagcctggtaccaacagaaacctggaccaggcctccgaggcctcctcatcgtagggatcggacactccgaaacgacggggcccgcgtacgggccaacgtcccccgaagtccccgtaagggttccgaagggttcgggacctaaggggttcgggggtccgttaggggggaacctaacggtacctttccgaacgtttccctaccgaaaccctaagttcccggaaacggcccgtaacggtacccgttaagggtaaccggtacccgtttaagggtaaacggttttaacgtttttacggtaaccgtttaaggttttttaaacgtttaaccgtttacggttaccgtaaacggttaaccgtaaaaccggtttaaaacgtttaacccggttaccgggttaccccgtttaccccggttaacccgtttacccggttaacccgggtttttacccgggggaacccgggggttaaccgggggtaacccgggtaacggggggttaaccgggtaaaccgtaacggttaaaccgggtaaaaacccggtaaaccggttacggggtaccgggtacggttaccgggaacccttaaaccgtacgtttccgtttaccggttaccgttttacccgtacccgtttccccgtttaaccccccgg

SEQ ID NO: 272750 - DNA, 584 bp, Homo sapiens
  misc_feature: GYAE6OF01DRDM4.47.76.G10.1.454.CMB.1.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagcccaccctctcctgccagggccagtcagagtgttggcagctacttagcctggtaaccanagaaacctggccaggctcccgaggcctcctcatctatgatgcatccaagcggccactggcatcccagccaggttcagtggcagtgagtcgngggacagtctcactctcacatcagcacgcctagngccgtagaagtatttgctactttattactgtcagtcacgcgtagacctaacgtcggccttcgtaccgtacgtttccgggacgggtaacgggtacccgtaggggtacgggtaacgtacggtaccgaagggaaccggtaaacgttcgggttacgggtacccgttacggaaccctaacccgtaacgtttcccgttcggtttacccc

SEQ ID NO: 272751 - DNA, 600 bp, Homo sapiens
  misc_feature: GYAE6OF01BIOUE.47.76.G10.1.454.CMB.1.raw
  modified_base (197)..(197): a, c, t, g, unknown or other
  misc_feature (197)..(197): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccaccctgtctttgtctccgaggggaaanagccaccctctcctgcagggccagtcagagtgttggcagctacttagcctggtaccaacagaacctggccaggcctcccgaggcctcctcatctatgatgcataccaacgacgggccacgtggaccactccccgagccctaggttccaggtggcagtgagtcgtagggacagtacttcgactctacaccatcagacacgtcctagacgtccgtagtaacgttagttttagaccgttactttacttacgttcgtacagtcgtacgtcgtacgctaacgtcggtccttctccgtacgtttccgggacgggtacgggacccggtaggggtacggaggtacgtacgaaggtaacggtaacgtcgggtacggccgtacggaccctaaccgacgtttcgttcgttaccg

SEQ ID NO: 272752 - DNA, 854 bp, Homo sapiens
  misc_feature: GYAE6OF01CSJQ7.47.76.G10.1.454.CMB.1.raw
  modified_base (200)..(200): a, c, t, g, unknown or other
  misc_feature (200)..(200): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagactatttgttttgacacagtctccagccacctgtctttgtctccgaaggggaaacngccaccctctcctgcgagggtcagtcagagtgttagacagcttacttagtctaggtaaccaagagaaacccgtgggaccagggcctacccgaggtcctccgtcatccgtaggggatcggactaactcccaacgcgggccctacgtgggacctaacgtccccgaggtccctaaggggtttccaagggttgggaccgtaagggttcgggggtacctagggggaacctaggtaaccctttccgaacctttccgtaccaaaccctagttccgaaacggccaacggtacccgtaaggacgtacccgttaaggtaaacgttagtttttacggaacgtttaacggtttttaacgtttaaccgttacggttaaccgtaaacggtaaccgttaaaaccggtttaaaacgttaaccggttaccgggtaccccgtttacccggtaccgtttacccggtttaaccgggttttacccggggaaccggggtaaccggggtaacccggtaggggggttaaccggtaaacggtaacggttaaaccgggtaaaaccgggttaaacggttacggggttaaccgggtaccgtttaaccgggacccgtaaacccgttacgttaccggtttaccgtttacccgtttaccgtaccgtttcccccgtttacccccgg

SEQ ID NO: 272753 - DNA, 719 bp, Homo sapiens
  misc_feature: GYAE6OF01AM7Y5.47.76.G10.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
tcagagctcacgtacacgaccggtgctcgatttagtcactcatacaggggaggaactgctcagttaggaccagagggaaccatggaagccccagctcagcttctcttcctcctgctactctggctcccagataccatcggagaagttgtgttgacacagtctccagccaccctgtctttgtctccgaggggaaancgcccaccctctcctgcagggccagtcagaatatcactcctacttagcctggaccaanacgaaacctggtcaggcctcccgaggtcctcctcatctatgatcgactactaccaacgcgggcctaacggtcggaccacgtccccgaagacgtaacgggtttccagggtacgggaccgtaggggttccggggtcgtacggggaacctaggtaccctttcacccgttaccttacccaaccgtagttacccgaacggtcccgtaacggtaccccgttaaggacccgtacccgtttaacgggaaacgtttaccgttttacgggttaaccttttacgttaccgttagttccgaacgtcgtacgggtccgttaggaccgttttcggtccgtcccgttcccggtcttacccggttcgttccgggggaccgggtacgggtaccggaggggttactaaacggacgttaaccgaaacggttcgtagggttcgaccttacggaccctacgttagtcccgtagttccgttctacccg

SEQ ID NO: 272754 - DNA, 507 bp, Homo sapiens
  misc_feature: GYAE6OF01BS4O4.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgaaacagtctccagccaccctgtctttgtctccaggggaaangccaccctctcctgcagggccagtcagagtgttggcagctacttagcctggtaccaacagaaacctggccaggcctcccaggcctcctcatctatgatgcatccaacgacgggccactggccatccccagccaggtcagtgcagtgagtctgggacagacttcactctcaccatcagcagcctagacgcctagaagtatttgctactttattactgtctagcagcgtagcaacgtcggcctctcctacgtttcgggcggacgggacgagggtggagagtcgaggacgacgtgtggctgcacatctgtcttcg

SEQ ID NO: 272755 - DNA, 521 bp, Homo sapiens
  misc_feature: GYAE6OF01EG2UX.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagacgcctagaagtattttgctactttattactgtcagcagcgtagctaactcggcctctcctacgtttcgggacggtacgggaccgaggggtcggagagtcgaggaacggaacgtggtcggcgtcggaccaccgactctggttcc

SEQ ID NO: 272756 - DNA, 528 bp, Homo sapiens
  misc_feature: GYAE6OF01BAKEP.47.76.G10.1.454.CMB.1.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgtttgacacagtctccagccaccctgtctttgtctccaggggaaagngccaccctctcctgcagggccagtcagagtgttggcagctacttagcctggtaccaacagaaacctggccaggcctccaggcctcctcatctatgatgcatccaacngggccactggcactcccagccaggttcaggtggcagtgagtcngggacagtcttcactctcacntcagcagcctagacgcctagtaagtatttcgactacttttatactagtccagctagcgtagcaacgtcggccctctctacgtttcggcggacggaccgtagggtcgaagtacgtcgaggaccgtaacgtggtcggacgtcgacctactcgtcgttgttaccc

SEQ ID NO: 272757 - DNA, 550 bp, Homo sapiens
  misc_feature: GYAE6OF01CQNOZ.47.76.G10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctntcctgcagggtcagtcagagtgttgacagctacttagtctggtaccaagagaacctggccaggctcccaggcctcctcatctgggatgcactccaacgagggcccgctcgggcactccccagcccgtaggttcaggtcggctaggtgggtctggggacaggacttcactcncacatcagcagcctagngcctagaagtattttgctagtttattactgtacagactaacgtaatacgtcgtcctccgctcgtacgttcgggcggtaggaccgtagggtacggacgacgtacggaaacgtaacgtcggtaggctggccaccgtagtctgttcttctcttcctccccg

SEQ ID NO: 272758 - DNA, 607 bp, Homo sapiens
  misc_feature: GYAE6OF01AX4CN.47.76.G10.1.454.CMB.1.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcagggccagtcagaatattcactcctacttagcctggtaccaacagaacctggtcaggcctcccgaggcctcctcatctatgatgcatccaacgcggccacgtggcactcccagactaggttcaggtggcagtgcgtcgngggacagtacgttcactcctacactataccaacncgtcctgcagtctagtaacgttagtttcgacttagtttacttacgtagtacagtactagtactacgtagtaacgtcggaccgtacttacccgtaccgttacggacccgaacgggtacctaaccggtacgtacggtaaacgtaacgtttaaaaccggtacgttacgggtacggaccttacgacccttaaaccgtcgttaccgttacgtttccgttacctacccg

SEQ ID NO: 272759 - DNA, 523 bp, Homo sapiens
  misc_feature: GYAE6OF01AMTZV.47.76.G10.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (349)..(349): a, c, t, g, unknown or other
  misc_feature (349)..(349): n is a, c, g, or t
  modified_base (514)..(514): a, c, t, g, unknown or other
  misc_feature (514)..(514): n is a, c, g, or t
tcagagctcacgtacacgaccggtgctcgatttagtcactcatacaggggaggaactgctcagttaggacccagagggaaccatggaagccccagctcagcttctcttcctcctgctactctggcctcccagattccaccggagacattgttttgacacagtctccagccaccctgtctttgtctccgaggggaaangccaccctctcctgcagggccagtcagagtgttggcagctacttagcctggtaccaanagaaacctggccaggctcccaggcctcctcatctatgatgcatccaacagggccactggcactccccagcctaggttcagtggcagtgagtcgngggacagacttcactctacacatcagcacgcctagacgcctagaagtattttcgacttacttttattactgtcagtcagcgtacgcaactcggaccttctcctcgttcggcggtacggcgagggtggagtacgtcgaggacgtacgtggtcggcgtcgcaccgtntcgtgttcc

SEQ ID NO: 272760 - DNA, 582 bp, Homo sapiens
  misc_feature: GYAE6OF01CWCO2.47.76.G10.1.454.CMB.1.raw
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccgaaggggaaagagcccaccctctcctgcagggccagtcagagtgttggcagctacttagcctggtaccaacagaaacctggaccaggctacccgaggcctcctcatctatcgatgctatccaacgagggccacgtggcactcccagcccaggttcagtcggcagtgagtcgtgggacagacttcgacttctcaacctataccagcacgcctaagacgaccctagtaagtagttttacgacttactttacttacttgtcagtcagtacgtagaccaacgtcggtacctctaccgtaccgtttcgggacgggtacgggaccggaggggtcggaaggtacgtacgacggaacgtaacgtcggtggtacgtcggacctaccgtactccgttgttacccg

SEQ ID NO: 272761 - DNA, 258 bp, Homo sapiens
  misc_feature: GYAE6OF01AVTBK.47.76.G10.1.454.CMB.1.raw
  modified_base (251)..(258): a, c, t, g, unknown or other
  misc_feature (251)..(258): n is a, c, g, or t
tcagagctcacgtacacgaccggtgctcgatttagtcactcatacaggggcagttccagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgcatctgatacgtgagctctgagcggctggcaaggcgcagtagnnnnnnnn

SEQ ID NO: 272762 - DNA, 551 bp, Homo sapiens
  misc_feature: GYAE6OF01EXOCN.47.76.G10.1.454.CMB.1.raw
  modified_base (196)..(196): a, c, t, g, unknown or other
  misc_feature (196)..(196): n is a, c, g, or t
  modified_base (367)..(367): a, c, t, g, unknown or other
  misc_feature (367)..(367): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagccaccctgtctttgtctccgaggggaaangcccaccctctcctgcagggccagtcagaatattcactcctacttagcctggtaccaacagaaacctggtcaggctcccaggctcctcatctatgatgcataccaacgagggccacgtggcactcccagacaggttcagtggcaggtgggtctgggacagtacttcactcncaccatcagcagcctagacgccgtagaagtacgtttaggtacttttattactgtacagctagtcgtgtacgttcgtcggtcctccgcgttccgtacgtttcgggacgggtacgggaccgtaggggtcgacgagtacggaaacgtagtggtcggctgacctacgtatcgttcgttccttctaccg

SEQ ID NO: 272763 - DNA, 537 bp, Homo sapiens
  misc_feature: GYAE6OF01BYKFV.47.76.G10.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagcaaccctgtctttgtctccaggggaaangccaccctctcctgcagggccagtcagagtgttggcagctacttagcctggtaccaanacgaaacctggccaggcctcccaggctcctcatctatgatgcatccaacagggccacgtggcactcccagccaggttcagtggcagtgagtcgtgggacagtactcactctcaccatcagcacgcctagacgcctagaagtatttgactactttattctgtacagctagcgttagctaactcggccttctctacgtttcgggacggtacgggaccgtagggtcggagtacgtacgaggacggtaacgtggtacggacgttcgaccgacctacttcgtgttaccc

SEQ ID NO: 272764 - DNA, 298 bp, Homo sapiens
  misc_feature: GYAE6OF01CS654.47.76.G10.1.454.CMB.1.raw
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (210)..(210): a, c, t, g, unknown or other
  misc_feature (210)..(210): n is a, c, g, or t
  modified_base (279)..(298): a, c, t, g, unknown or other
  misc_feature (279)..(298): n is a, c, g, or t
tcagagctcacgtacacgaccggtgctcgatttagtcactcatacaggggcagttccagacttcactctcaccatcagcagcctagagcctgaagattttgcactttattactgtcagcagcgtagcaactggcctctcactttcggcggagggaccagggtggagatcagacgaactgtggccngcacntntctctcacttccgtcccnctatctagtactacgtagacgtcctcgtggacgggcggtcggtcggaacggaacgggccactaagtagnnnnnnnnnnnnnnnnnnnn

SEQ ID NO: 272765 - DNA, 615 bp, Homo sapiens
  misc_feature: GYAE6OF01BI7OR.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggaccaggcctcccaggcctcctcatctatggtgcactccaaacgacgggcccaacgtggccactccccgagcccagggtttcaggtggcaggtgggtctggggacaggacttcactctcacatcagtccagcctagacgcctagaagtatttagacttagtttactactgtcaagtactaacgttaaactacgtacggtaccctccgtaccttacgtaccgtttcgggaccgggtaacggggtacccgtaggggtacggaacgtagtaacggaaaaccgtacggtcggtaggtccgttacgccctaaccgtacttaccgttcgttaccttacctacgttcccgttacccccg

SEQ ID NO: 272766 - DNA, 559 bp, Homo sapiens
  misc_feature: GYAE6OF01E4A4G.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccaggcctcctcatctatgatcgcatccaacagggccacgtggcatcccagccaggttcagtggcagtgagtcgtgggacagacttcactctcacctatcagcagcctagacgtccctagtaacgtattttgacttaacgttttatacttgtacagctagcgtagctaacgtcggcccttctctacgtttccgggacggacgggtaccgtaggggtcggaggtacgtcgaaggaaccgtacgttggtacggaccgttacggaccctaaccgattccgtggtttaccc

SEQ ID NO: 272767 - DNA, 697 bp, Homo sapiens
  misc_feature: GYAE6OF01DXNVU.47.76.G10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccaccctgttctttgtctccaggggaaangcccaccctntcctgcagggccagtcagngtgtgcagctatgcctggtaccaanagaacctgccaggctccaggctcctnatctatgatgacactccaaacgacgggcccaagtcggactactcccaggtcccaagggtttcaaggtcgctaggtcggaagtcgtaggggaactacggacctttacacttcctaccaacctagttaccgagccgtaacgtacccgttaaggaccgtccgttaaggtaaacgttacgtttttacggacctttaactttttaactttaacgttgtaacgtaacgtacgtaacggtacggtaacgtaccgtaaccgttcgggtccttaccgttaccgttaccgggttttacgggaccggggtaacgggtacccggaaggggggttacgggtaaggtaacggtaaccggaaggtaaaccgggtaccggttacgggttcggtaaccggtcggaaccctaacccgttagttcccgttcggtttacc

SEQ ID NO: 272768 - DNA, 741 bp, Homo sapiens
  misc_feature: GYAE6OF01DCJZZ.47.76.G10.1.454.CMB.1.raw
  modified_base (206)..(206): a, c, t, g, unknown or other
  misc_feature (206)..(206): n is a, c, g, or t
tcagagctcacgtacacgaccggtgctcgatttagtcactcatacaggggaggaactgctcagttaggacccagagggaaccatggaagccccagctcagcttctcttcctcctgctactctggcctcccagattccaccggagactattgttttgacacagtcctccacgcccacccttgttctttgtcctaccgaaggggaaanacgcccaccctctcctgcgacgggccagtcagagtgtggcagcttactacgcctacggtaaccaaacgaacgtaaacccgtggacccaggtccctacccgaggtcccttccctatacttcgtaaggttcgggtacacctacgtacccccgaaccgaccggggccctaacgtcgggaccctaccgtaccccgaagaccgtaggttcgaagggtcggtacgtagggttcgggtacgtagggaactaggtcgttacctaacgttcctaccaaccgtataccgacgacccgtacggtcccgtagaccgttaacggttcgttaacggttaaagttttacgtttttacgaacttttaaattttacttacgtgtactaacgtaactaaagtttaaacttaaacgtacgttccggtaccttaccggtacgttaccgggaaccgtaacgggaaccacggtacgtagggtaactaaacgtaaacgacgtggtacggacctcgaccctagtacttcgttacttacctcgtacgttccccgtacccg

SEQ ID NO: 272769 - DNA, 745 bp, Homo sapiens
  misc_feature: GYAE6OF01DVQ5V.47.76.G10.1.454.CMB.1.raw
  modified_base (194)..(194): a, c, t, g, unknown or other
  misc_feature (194)..(194): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagacattgttttgacacagtctccagccacctgtctttgtctccaggggaangccaccctctcctgcagggccagtcagagtgttggcagctacttagcctggtaccaacagaaacctggaccaggcctcccgaggcctcctcacttctaatgatcgacatcccaaacgcgggcccacgtggccacgtccccagtccctagggttccaggttcggctaaggttcgaacggttccgtagggggaacctaagggttacctttccgaaccgtttcctaccaaacccgtactaccgacgaccgtaaacggtcccgttaaagggacgtaccccgtttaaggaaacggtttaacgttttttacggacccttttaaccgttttttaacggtttaccttaggtttaccgaacgtaccgtaggtaccgtaacgaccttaacggtccggtacccttcgttaccggttaccgtttccggggaccgggtaacgggtacccggtagggggtacgggtaaacgtacggttacccgaaaggggtaacccgttaaacggttcgggtaggtacccggttcggtaaaccctacccgttaacgtttcccgttcggtttaccc

SEQ ID NO: 272770 - DNA, 803 bp, Homo sapiens
  misc_feature: GYAE6OF01DA57W.47.76.G10.1.454.CMB.1.raw
  modified_base (193)..(193): a, c, t, g, unknown or other
  misc_feature (193)..(193): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtcttgtctccgagggaanagccaccctctcctgcagggccagtcagagtgttggcagctacttagcctggtaccaacagaaaccgtggaccaggcctacccgaggcctcctcacttctatgtatcgactactacccgaaacgacggggacccacgtccggacctaacgttacccccgaaggccccgtaaaggggtttcccaaagggtttcgggaccctaagggttcgggtaacggttccggttagggggaaacctacggtacccttttaccaacccgtttccctaccaaccccgtaattcccgaacggaccgtaacgtaccccgtaacgggacggtacccgttaaggtaaacggttaacgtttttacggacccttttaacgtttttaacgtttaaccgttacggttaccgtaacggtaccgtaagggtaccggttaacggtaccgttaaaccgttccgggtacccttccgttacccgttaccggttttaccggggaccggggtaccggggtaacccgtaggggggtacgggtaacggtaaccgtaaccgggtaacgggaaacccgtacgggttcgggttacgggacgttaccgggaccctaacccgtacgttccgttacggtttaccc

SEQ ID NO: 272771 - DNA, 602 bp, Homo sapiens
  misc_feature: GYAE6OF01EBVCT.47.76.G10.1.454.CMB.1.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (388)..(388): a, c, t, g, unknown or other
  misc_feature (388)..(388): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaanagccaccatctcctggtacgggccgtcagagtattagcatcaacttagcctggtaccaacagaaacctggcaggcctcccgaggcctcctnatcgtgggatgccatccgaacgacggggcccngtcggcctacgtccccaagcctaggttcagggtcggcaggtgggtcgtgggacacgtcttcactctcacntcagcagctagcgtctagacgtactttgtactttattactgtcagctaggtcgtgtacgttcgcgtcctccgtcttccgtacgggtttcggacgggtacgggaccggtaggggtacggaacgtaacgtaccgaaaaccggttacgtggtacggtccttcggacctaaccgtacgttccgttacgttaccctttactaccgttccccgttacccg

SEQ ID NO: 272772 - DNA, 623 bp, Homo sapiens
  misc_feature: GYAE6OF01ES5MR.47.76.G10.1.454.CMB.1.raw
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccacctgtctttgtctccgaggggaaangccacctctcctgcagggccagtcagagtgttggcagctatagctggtaccaanacgaacctggaccaggcctccaggctcctcatctangatcgacactaccgaacgcggccacgtcggactactccagcctaggttcaggtgcagtgacgtgagggacagtctcactcacactactcacgcacgcctaggctaccgtagtaacgttacgttttagacctttaacgttttaacgtacgttcgtacaaggtctacggtcgtaacgtccgtaacgtcggtcccttacgttaccgttacggtttaccgggacgggtacggggtacccggtaaggggttcggaaagttacgtaccggtaacggaaccggtaacggttccgggtacggacgttaccggaaccgtaacccgtacgttccgttggtttacccc

SEQ ID NO: 272773 - DNA, 672 bp, Homo sapiens
  misc_feature: GYAE6OF01DFBYO.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaagagcccaccctctcctgcagggccagtcagagtatagcagcaacttagcctggtaccagcaagaaaccctgggcaggcctcccgaggcctcctcatctagtggtgccatcccaccgagggcccacgtggtactccccgagccaggttccaggtcggcgtaggttcggggtctaggggactaggtagtttccacgttcctacgacccagttcacgccacgtcccgttgaccgtaggttaccgtaggtaaacgttagtttttacggacgtttaagtttttaacttacttgttacgtaacgtaaccgtaaaacgttaaactaccgttacggtcccttacccgtccttaccgttaccggttttccggggacgggtacggggtaccgtaaggggttcgaaccgtaggtacggaaaaccggtaacgttggtacggccttcgacctacccgttacgtccgttcgttaccttcgtacgttccccg

SEQ ID NO: 272774 - DNA, 766 bp, Homo sapiens
  misc_feature: GYAE6OF01AOZI3.47.76.G10.1.454.CMB.1.raw
  modified_base (198)..(198): a, c, t, g, unknown or other
  misc_feature (198)..(198): n is a, c, g, or t
tcagagctcacgtacacgaccggtgctcgatttagtcactcatacaggggaggaactgctcagttaggacccagagggaaccatggaagccccagctcagcttctcttcctctgctactctggctcccagacttccaccggagacatttgttttgacacagtctccagccaccctgttctttgtctccgaggggaaancgcctaccctctcctggcgacgggccagtcaggtagtgttggcagtctaacgttagccctaggtaacccaaacgaacgtaaaccgtcggaccaacgggtccctacccgaggtcccttccctacaacttccgtaatacggaacttcggacctaaaccgtacccgaaaccgtacgggggaccctaacggttcgggaccctaccttaccccgaacggtacccggttagggtttaccgaagggttcggtacgtaagggttacgtaacggttcgtaacggggaaccctaggtacccttcgacctctaccaccgtactccgaacgacgtacgaccgtaggaccgtacgtaaggtaagttactttacggtaacctttaacgttttacttacgtcgtacgtacgtacgtacgtacgtacgtaccgtaaccgttccggtaccttaccgtaccgttcggtttaccgggacgggtaacgggtaccggtaggggttacggaacgtaacgtacggtaacggtaaccggtacgttcggtaacggtccgttaaggaccgtaaccgtcgttccgtcgttacccg

SEQ ID NO: 272775 - DNA, 544 bp, Homo sapiens
  misc_feature: GYAE6OF01BLU3H.47.76.G10.1.454.CMB.1.raw
  modified_base (195)..(195): a, c, t, g, unknown or other
  misc_feature (195)..(195): n is a, c, g, or t
  modified_base (379)..(379): a, c, t, g, unknown or other
  misc_feature (379)..(379): n is a, c, g, or t
  modified_base (424)..(424): a, c, t, g, unknown or other
  misc_feature (424)..(424): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagccaccctgtctttgtctccaggggaaanagcccaccctctcctgcagggccagtcagaatattcactcctacttagcctggtaccaacagaaacctggtcaggctcccaggctcctcatctatgatgcatccaacagggccacgtggccatccccagccaggttcaggtggacagtgagttcgagggacagtacttcactctcaccatcacncagcctagcgcctagaagtctttagactactttattactgtacancgtagcgtagctaactcggccctctacttaccgttcgggacgggtacgggccgtagggtggagtacgtcgaggtacggtaacgtcggtggcgtcgaccacccgtacgttcttggttaccc

SEQ ID NO: 272776 - DNA, 576 bp, Homo sapiens
  misc_feature: GYAE6OF01EATRY.47.76.G10.1.454.CMB.1.raw
  modified_base (199)..(199): a, c, t, g, unknown or other
  misc_feature (199)..(199): n is a, c, g, or t
tcagagctcacgtacacgaccggtgctcgatttagtcactcatacaggggggaggaactgctcagttaggacccagagggaaccatggaagccccagctcagcttctcttcctcctgctactctggcctcccagattccaccggagacattgttttgacacagtctccagccaccctgtctttgtctccgaggggaaanacgccaccctctcctgcagggccagtcagagtgttggcagcaacttagcctggtaccagcaagaaacctgggcagggcctcccgaggcctcctcatctatgatgccgtccaccgagggccctacgttcggttcccaggcctaggttcaggtcggctaggtgcgttctgggactaggtacgttcacgtctacacatacaactagcctgctacgtcgtagaagttatttgacttagtttacttactgttacagtctagtactctaatacgtcgacccgtctcgtacccgttcggaccgaacgggaccacggactaggactaagttaaacggacgttaggagtctacgctaccgtattcgttcgtccttctacttccccg

SEQ ID NO: 272777 - DNA, 660 bp, Homo sapiens
  misc_feature: GYAE6OF01DTGDK.47.76.G10.1.454.CMB.1.raw
  modified_base (198)..(198): a, c, t, g, unknown or other
  misc_feature (198)..(198): n is a, c, g, or t
tcagagctcacgtacacgaccggtgctcgatttagtcactcatacaggggaggaactgctcagttaggacccagagggaaccatggaagccccagctcagcttctcttcctcctgctactctggctccagattccaccggagacatttgttttgacacagtctccagccaccctgttctttgtctccgaaggggaaanagccaccctctcctgcagggccagtcagagtgttggcagctacttagcctggaccaacagaaacctggccaggcctcccgaggcctcctcatctatgatgcatcccaaacgacgggcccacgtggacactccccgaagcctagggttcaggtcggctaggtgacgtcgtaggggactaacggtcttacaccgttcctaccgaacctagtaccacgactacgaccgttaacgacgtaccgttaaggtaaacgttatttttacggacctttaacgtttttaacttacctttcgttacgtaagtacgtacggtaccgttacgaccgtaacgtccggtcccttacgttacccgttacggtttcgggaccgggacgggtaacccggaggggtacgggaacggtaagtaccgaaggaaccggtacgttgggtcggacgtacggacctaccgtacgttcgttcggttac

SEQ ID NO: 272778 - DNA, 668 bp, Homo sapiens
  misc_feature: GYAE6OF01AIE82.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccagggggaanagccaccctctcctgcagggccagtcagagtgttggcagctacttagcctaggtaccaacagaaaccctgcccaggcctcccgaggtcctcctcatctatgatcggcatcccaacgacggggccaacgtgggaccactccccaaggccgtaggttccaggttcgggactagtcggagtcgtaggggacaacggtacctttacacctccgttaccaacccgattaccgacgggccaacggacccttaagggacgtacccgtaggtaaacgttatttacgtaccttactttttaacttacgtacggtctacggactacggtacgttaacgccgtaaacggtccggtaccttccgttaccgtccgtttacgggccgggtaacggggtaccgtaggggtcggaaggtactcggaaggtaaccggtacggttacggtccgggacgtacggtacccaccggtacttcgttccgtttacc

SEQ ID NO: 272779 - DNA, 702 bp, Homo sapiens
  misc_feature: GYAE6OF01DUTTU.47.76.G10.1.454.CMB.1.raw
  modified_base (245)..(245): a, c, t, g, unknown or other
  misc_feature (245)..(245): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagactatttgttttgacacagtctccacgccctaccctgttctttgtcctccgaaggggaaagacgccctaccctctccgtgcgacggccagtcagagtgtgcngctatagcctaggtaccaagtaacgaaccgtggccaggcctaccgagtcctctcatcatgatcgcactccgaacgcggacccagtcggaccacgtccccgaagtcccgtaaggttacgaggtcggacgacgttaggcgtacggagggtaccaaggttccttacaccgttccgtaccaacccgtagtacgaacgtaccgaacgtacgttaacggcctaccgtaaaggtaacttcttttaggaccttttactttaacttcgtacgtcacgtacgtaggtacctagtaccctaacgttccgaccgtttcctaccggtttaccgggttacgggccgggggttaaccggaccggtagggggtaccgtaaagttaccgggtaacgtaccgggaaacggtttccgggtacggggtttacgaccgtaaccgaccgttaccgtacgtttcggtttacccggtaccc

SEQ ID NO: 272780 - DNA, 551 bp, Homo sapiens
  misc_feature: GYAE6OF01DLP5A.47.76.G10.1.454.CMB.1.raw
  modified_base (196)..(196): a, c, t, g, unknown or other
  misc_feature (196)..(196): n is a, c, g, or t
  modified_base (537)..(537): a, c, t, g, unknown or other
  misc_feature (537)..(537): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgctccgaggggaaangcccaccctctcctgcagggccagtcagagtgtggcagctacttagcctggtaccaacagaaacctggaccaggcctcccgaggtcctcctcatctatgatgcatccaaacgcgggccacgtggcactccccagccctaggttcaggtcgcagtgagtctagggacaggacttcacttcacaccatcagcacgctagcgctagaagtatttacgactactttattactgtcagctagcgtagacacgtcgtcctctcgtacgtttcgggacgggtaggacccgtaggggtacggagtaacgtcgaagggtacgtaacgtgggtcggacgtcgacctacctnttccgttggttacc

SEQ ID NO: 272781 - DNA, 569 bp, Homo sapiens
  misc_feature: GYAE6OF01BU7D4.47.76.G10.1.454.CMB.1.raw
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
tcagagctcacgtacacgaccggtgctcgatttagtcactcatacaggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctggggacgtccctgagactctcctgtgcagcctctggattccaccttcagttactatactatgcacgtgggtccnccaggcctccgaggcgaaggggctgggagttggngctagttatatcatagtgatggaancagcaatatattacacgagacctcgtaggaacgggcctattcgaacctatcctacaagacgaactaattaggaaacaacgacgtctagtactcgtagtacaaagttacgaacgacgaccgtaggaacgacgtacgtagaaacggaaccgtacgggttcttaggtttacggttttacgtaggtacgacggtaaggaagtacggtaacgg

SEQ ID NO: 272782 - DNA, 647 bp, Homo sapiens
  misc_feature: GYAE6OF01CCT54.47.76.G10.1.454.CMB.1.raw
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
  modified_base (402)..(402): a, c, t, g, unknown or other
  misc_feature (402)..(402): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagactattgtttgacacagtctccagccacctgtcttgctccgagggaangccaccctctcctgcagggccagtcagaatatcactctacttancctgtaccaanagaactggtcacggctccagctccncatctatgatgactactaccgaacgcggacccacgtcggactacgtaccccaggaacctggttacgaaggttcggacgtaggtcgggtcgtaggggaactacggtaccttccgtaactctaccgaacctancctaagccgacgcccgtaagacgtccgtagtaacgttacgttttaggtaacttttaattaccgttgtcgaagtaccgtgtacggtacgtacgtttccgcgggtcccgttcccgtccgttaccgttaccggtttcgggaccgggtaacgggtcccgtaagggggtcggacgtaccgtaaacggtaaacgtacggtggttacggcgttcgaacctactcgttactacgttacctcgttcctccccgg

SEQ ID NO: 272783 - DNA, 560 bp, Homo sapiens
  misc_feature: GYAE6OF01BZV4H.47.76.G10.1.454.CMB.1.raw
  modified_base (196)..(196): a, c, t, g, unknown or other
  misc_feature (196)..(196): n is a, c, g, or t
  modified_base (392)..(392): a, c, t, g, unknown or other
  misc_feature (392)..(392): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggccaggcctcccaggctcctcatctatgatgcgtccaccgacggggccctacgtcggtttccccaggtccctagggtttccaggtggcaggtgcgtcgtggggacagtagttcactctcaccatcaacncgcctgcagtctagtaagtattttgacttagtttattactgtcagtctagttaataataacgtggtcctcgtcttcggaccgtaacgggacacgacgtaggagtaacgttaaacgactggtaggcgtagaccacgtctcgtcgttcttactacttccttcccgctacg

SEQ ID NO: 272784 - DNA, 679 bp, Homo sapiens
  misc_feature: GYAE6OF01D60NA.47.76.G10.1.454.CMB.1.raw
  modified_base (201)..(201): a, c, t, g, unknown or other
  misc_feature (201)..(201): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagacattgttttgacacagtctccagcccaccctgttctttgtcctccgaaggggaaanacgcccaccctctcctagcgagggccagtcagagtgttggcagctacttagccgtggtaccagcaagaaccgtgggacaggctcccgaggcctacctcatctatgatcgactactaccaaacgcggacccacgtacggccacgtccccaaggaccgtaggttcaggtacggacgtagggtcgggttcgaggggactacggtaccttcgaacctctaaccacgtactcgagccgtactccgtaggacgtaccgtagtaaacgttagtttacggtaacttttacgttactggttaccaaggtccgtaacggtccggttgtaccggtttccgtccggtcccgtcccgttacttacccggttccgtttaccggggaccgggtaaccgggtacggtacggggttaggaacgttaacgaaccgtaaacgggtaacgttggaccggtccgtacgtacccgacttagtccctttggtcccttaccg

SEQ ID NO: 272785 - DNA, 630 bp, Homo sapiens
  misc_feature: GYAE6OF01EEZT7.47.76.G10.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccgaggggaaanagccaccctctcctgcagggccagtcagagtgttgacagcttacttagtctggtaaccaagacgaaacctggccaggcctcccagcctcctcatcgngggatcgacactccaacgagggcccgcgtggccaactccccgaagcccgtaggttccaggtcggctaggtgggtcctggggacctaggtaccttccacgttcctacacctagtcacgtcacgccgtagacgcctagaacgtactttagtaacgttttacttaccgtgtctaacgtcgtacgtacgtggtagtttccgtcggtcccttccgaccttccgtaaccgttttccgggacgggtacgggaccggtagggtacgggaagtaccgtaacgaaacgtaacgttggtaggtccgtagccctaaccgtacttacttacgttcttcctcgttccccg

SEQ ID NO: 272786 - DNA, 690 bp, Homo sapiens
  misc_feature: GYAE6OF01C1KID.47.76.G10.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagaagttgtgttgacacagtcctccagccacccttgtctttgtctccgaaggggaaancgcccaccctctcctgcagggccagtcagaatatcactcctacttagcctggtaaccaanagaaacctggtacaggcctccaggcctcctcatctatgatgcactccaacnggcccagtggccactacccagactaggttcaggtgctaggtcgggtcgtgggacagtacttcacttcgaccacagtcacgctacgaccgtagtacgaccgtaggtaaacgttacgttttaggttaaccttttaacgttaccgttcgttaccgaacggtctaacgggttccggttaggtaccggttttccgtaccggtcccctttcccggccgtttaccgttaccgggttttaccggggccgggtaaacggggcccggtagggggtacggtaacggtaaaccgtaaccggaaaaccggttacgtgggttaccggtcgttacccgaccgttaacccgttacgtttccgttacgtttacccttccgttaccgtttacccccgg

SEQ ID NO: 272787 - DNA, 683 bp, Homo sapiens
  misc_feature: GYAE6OF01AB5ET.47.76.G10.1.454.CMB.1.raw
  modified_base (194)..(194): a, c, t, g, unknown or other
  misc_feature (194)..(194): n is a, c, g, or t
  modified_base (304)..(304): a, c, t, g, unknown or other
  misc_feature (304)..(304): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagcccacctgtctttgtctccaggggaangccaccctctcctgcagggccagtcagagtgtgcagctactagcctggtaccaagagaaacctggaccaggcctcccgaggtcctcctcatctatgatgacatccaacgngggcccagtggacctactccccgaagcctagggttcagggtcggactaggtgaggttccgtaggggaacctaggtactttccgaacttccgtacaaccagttcccaagccgaacgtaccgttaacgacgtaccgtaggtaaacgtacgtttagggtaaccttttaacgtttacgtagtacgacgtacgtacggtcgttagacgttccgtaccggtcccgttccgttaccgttaccggttaccggtttaccggggacgggtaaccgggtaccggtacggggttcggaaacgtaacgtaacggtaaaccgtaacggttcgggtacgggtaccgttacggtacccgtaacccgttagtttacccgttaggttcccttaaccg

SEQ ID NO: 272788 - DNA, 734 bp, Homo sapiens
  misc_feature: GYAE6OF01DLF7F.47.76.G10.1.454.CMB.1.raw
  modified_base (197)..(197): a, c, t, g, unknown or other
  misc_feature (197)..(197): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagcccaccctgtctttgtctccgaggggaaancgcccaccctctcctgcgagggccagtcagtagtgttgcagctactgccgtaggtaccaacgagaaacctggaccacggcctcccgaggtcctcctcagttcctagtgatcgacactacccgaaacggacgggacccacgtcggaccaccgttaccccgaggaccccgtagggtttaccagggtcggactaggtacgtacggttccggtaggggaacctacggtaccttaccgaccttacctaccgtaacctactaccggacgaccgtaaccgccttaaggacccgtaccgttaaggtaaacgtttacgttttcgaaccttttaaccttttagttaaccgtggtactacggtacgtacggtaccgtaacgaccgtaaccggtcggtccctttaccgtaccggttaccggtttaccggggaccgggtaaacgggtaccgggtagggttacggacgtaaccgtacgggaaccgtaacggtcggttacgggtcggacccgtaccgaaccgttaacccgtcgtttccgttccgtttacccg

SEQ ID NO: 272789 - DNA, 553 bp, Homo sapiens
  misc_feature: GYAE6OF01A1J7U.47.76.G10.1.454.CMB.1.raw
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggcctcccaggctcctcatctatgatgcatccaaacgngggccactcggcactcccaagcccaaggttcaggtcggcagtgagtcgtagggacagtacttcactctcaccatcagcacgcctagacgcctgaagtatttgactacttttattactgtacgagtcagcgtagcctaacgttcggtaccctctcgtacgttcggacgggtacggaccggtagggtcgggagtacgtacggaggacgtaacgttcggcggtctacggacctaccgtacttcgttgttcc

SEQ ID NO: 272790 - DNA, 870 bp, Homo sapiens
  misc_feature: GYAE6OF01CVVVN.47.76.G10.1.454.CMB.1.raw
  modified_base (201)..(201): a, c, t, g, unknown or other
  misc_feature (201)..(201): n is a, c, g, or t
tcagagctcacgtacacgaccggtgctcgatttagtcactcatacaggggaggaactgctcagttaggacccagagggaaccatggaagccccagctcagcttctcttcctcctgctactctggcctcccagacttccaccggagactatttgtttgacacagtcctccagcctaccctgtctttgtctccgaaggggaanacgccacccttctcctgcgagggccagtcaggagtggttagcagctacgttagccgtaggtaccaagacgtaaaccgtggaccaggcctacccgaggtaccttccgtacaactttcgtattcggaactccggacctaacgtaccccgaaacggcggggaccctacgtacgggacctaaccgttacccgacgggtaccccttaaggggtttcccgaagggtccggggtaccgtagggttacggtacggttccggtaagggggaaccttaaccgggtacttttacccgtaaccgttcccctaaccaaaccccgtatacccgggaaacggttcccgaaaccggttacccgttaaacggaccggttacccgttaaagggtaaacgttttactttttaccggtaaccttttaaacttttttaacggttacgtttcccggagtaacgggttacaagggttaccgtaacccgtaaccggtttaacggttccggtttaacccctttccggttaaacccgggttcccggggttttaagggggaaccccgggttagggggtaaacccggtgggggtacggaacggttaacggtaccggaaacgggtttacgaaccgggtttggacgggttaaccgtccggaacccgtaaccgttcggtttacccggttccgtttaaccg

SEQ ID NO: 272791 - DNA, 798 bp, Homo sapiens
  misc_feature: GYAE6OF01EJN0T.47.76.G10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagactattgttttgacacagtctccagccacctgttctttgctccgaaggggaancgccaccctctcctgcgacggccagtcagngtgtgcagctacgtagcctaggtaaccaagacgaaacctcggaccacggcctacccgaggtcctcctacattcctatggactgacctactaccgaaacgcggacctacgtcggacctaccgtacccgacggtcccgtaacgggtttacgaacgggtcggtacgtacggggtcgtaacgggttcggtaacgggaacccgttacgggtaccctttaccgtaccttacccgttaacctaaccgtaacgttacggaaccggttacctaacccggttacccgtaagggaaccccgtaccggtttaaagggttaaacttacgttttacggtaaccttttaacgtttttaacgttaccgttacgtactaacggccgtaacggttcgtaacgacgttaaccggttccgtacccgttccgttaccgggttaccgttacccggggaccgggttaaccgggaaaccgggtgggggtaactaacgggtaccggtaaccggtaaacgggtaccgggttaaacggtcggggttacgtaacccggttcggaaccttaaacccgtgttttcccgtaccgtttacccg

SEQ ID NO: 272792 - DNA, 635 bp, Homo sapiens
  misc_feature: GYAE6OF01DDJTL.47.76.G10.1.454.CMB.1.raw
  modified_base (202)..(202): a, c, t, g, unknown or other
  misc_feature (202)..(202): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagactatttgttttgacacagtctccagccacccttgttctttgtctccgaaggggaaancgcccaccctctcctgcagggccagtcagagtgttggcagctacttcgcctaggtaaccaacaacgaaacctggaccagggcctacccgaggtccctcctcacttctatggatcgacatacccaagacggccacgtcgcactcccaggccctaggtcaggtcgactagtcgagtcgtaggactacgtaccttcgaccttcgtacacctataccgacgacgaccgtacgtaacgacgtacctagtaacgttacttttacgacctttaactttattacgtcgtactacgtcacggtacgtacgactaaccgttcggtacccttcgtacgttccggttacggggacggtaacgggtaccggtagggtacggaacgtacgttacggaagtaccggtacgttcggacgtcgaccgtacgacgttctcgttcgttaccc

SEQ ID NO: 272793 - DNA, 663 bp, Homo sapiens
  misc_feature: GYAE6OF01D2B86.47.76.G10.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (333)..(333): a, c, t, g, unknown or other
  misc_feature (333)..(333): n is a, c, g, or t
  modified_base (641)..(641): a, c, t, g, unknown or other
  misc_feature (641)..(641): n is a, c, g, or t
tcagagctcacgtacacgaccggtgctcgatttagtcactcatacaggggaggaactgctcagttaggacccagacggaaccatggaagccccagcgcagcttctcttcctcctgctactctggctcccagactaccactggaagaaatagagatgacgcagtctccagcccacctgtctttgctacgaaggggaancgcccacctctcctgcgaggtcagtcagagtgtagacagcttagttagctaggtaaccaagacgaaacctggacccaggccctacccgaggtcctcctnacgtcgtgggactgccaatacccgaacggacgggccncgtacggctaacgtaccccgagtcccgtaggtacaggtcgacgtagggtcgggtctaggggacaagtccgtcacctctaccaacctatacgacggactaacggtcctaaggctacccgtagtaacgttattttgacctttagttttacttaccgttataccgaagtacgtaaacgttaacgtaccggtacggtacccttccgtaccgttaccgttacccgggtttcgggaaccgggtacgggaaccggtagggtaccgagtacgtaaacggaaaccggtgtacggtacggtcgtacgacctaaacgtnttgttacgttctccgttacccg

SEQ ID NO: 272794 - DNA, 252 bp, Homo sapiens
  misc_feature: GYAE6OF01BX1ZY.47.76.G10.1.454.CMB.1.raw
  modified_base (250)..(252): a, c, t, g, unknown or other
  misc_feature (250)..(252): n is a, c, g, or t
tcagagctcacgtacacgaccggtgctcgatttagtcactcatacaggggcagttccagacttcactctcaccatcagcagcctagagcctgaagattttgcactttattactgtcagcagcgtagcaactggcctctcactttcggcggagggaccagggtggagatcaaacgactgtggctgcaccatctgtcttcatcttcccgccatctgatacgtgagctctgagcggctggcaaggcgcatagnnn

SEQ ID NO: 272795 - DNA, 595 bp, Homo sapiens
  misc_feature: GYAE6OF01EEM53.47.76.G10.1.454.CMB.1.raw
  modified_base (194)..(194): a, c, t, g, unknown or other
  misc_feature (194)..(194): n is a, c, g, or t
  modified_base (470)..(470): a, c, t, g, unknown or other
  misc_feature (470)..(470): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccttgtctttgtctccaggggaanagccacctctcctgcagggccagtcagagtgttggcagctacttagcctggtaccaacagaacctggccaggcctcccgaggcctcctcatctatgatgcactaccgaaacgcgggcccagtcggcctaacgtccccaagcccgtaggttccaggtcggctaaggtgacgttcgagggacagtacctcgactcaccaactatcgacgcaacgcctagacgtccgttagtaaacgttatttgaccttacttttatacgtagtcagtcgagtacgtanacgtaacctggtcctattccgtacgttcgggacgggtaacgggacgtaggggtacggacggtagtacggaacggtacggtaacgttcgggtacggtctacggacctaacctagttcgtcgttacc

SEQ ID NO: 272796 - DNA, 526 bp, Homo sapiens
  misc_feature: GYAE6OF01A3C5E.47.76.G10.1.454.CMB.1.raw
  modified_base (195)..(195): a, c, t, g, unknown or other
  misc_feature (195)..(195): n is a, c, g, or t
  modified_base (372)..(372): a, c, t, g, unknown or other
  misc_feature (372)..(372): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccacctctcctgcaggccagtcagagtgttggcagctacttagcctaggtaccaacagaaacctggaccaggctcccaggctcctcatctatgatgcgtaccaccgagggcccactcggtttcccagccaggttcagtgcagtgcgtctgggacagagtcatctcaccatcgaacngcctgcagtctagtaacgtatttgactagtttaatacctgtcagctagtataatactggactcgacgttcggaccgtaaggactacgacgtgaacgtataaacgtacgtaggttagacttgacacacgtctgttcttactatccttccgccgta

SEQ ID NO: 272797 - DNA, 898 bp, Homo sapiens
  misc_feature: GYAE6OF01BLGJP.47.76.G10.1.454.CMB.1.raw
tcagagctcacgtacacgaccggtgctcgatttagtcactcatacaggggaggaactgctcagttaggacccagagggaaccatggaagccccagctcagcttctcttcctctgctactctggctcccagattccaccggagactatttgttttgacactagtcctccgagtccctacccttggttccttttcgtcctaccggaagggggaaacgacgcccctaaccccttcgttccctaggaccgacggggttctaacggtcaaggtaggttaggttacggaacacggtaccttaacgtttacggtccgttaacgggtaaccaaaaggaacgtaaaacccgtgggacccgtaagggcccttcccgaagggtcccttcctacgtaagttccggtagggaacttcggacctaacgttaccccgaaaacgggtccggggcccgtacggtacggtacctaaccgtccccgaaggtacccgttaggttaccgagggtcggaaccggtggttacgggggttaccgtacgggggtaacctaggtttaacccttacgtaccgttacccgtaccaacccgttataccggaacgtaccgtacgtaccgtacggtaccgtccgtaagtaacgtttacgtttacgtactttaacggttttacttacgtcgttaactacgtaaaccgttaaacgtttaacggttaccgttaccgtacccgttaccgttaccgttaaccggtttaccgggtttaccggggacggggtacccggggaacgggttacggggtaaccgtaaacgtaaacgggtaaacgaaaacccggtttcggtagggttaccggacgttacggaaccctacgtaccgtttcgttacggtttacccttacccggttaccttccccggtaacccc

SEQ ID NO: 272798 - DNA, 606 bp, Homo sapiens
  misc_feature: GYAE6OF01E1L3O.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccaccctgtctttgtctccaggggaangccaccctctcctgcagggccagtcagagtgttggcagctacttagcctggtaaccaacagaaatcgtggccaggcctcccaggctcctcatctatgatgctatccaagacgggccacgtggccacgtccccagtccgaggttcaggtcggctaggtgaggttcgtagggacagtactttcacttcacaccatccacgcacgcctagacgtccgtagacgtatttcgacttactttattacgtgtacagtcgagtcgttgtacgttccgtacggtcccttccgtcgttaccgtaccgtttccgggacgggtaaccgggtacccggtaggggttaccggtaaccgtaagttaacggtaaaccggtacggttggttacgggtaccgtacggacccaccgtacgttccgttacg

SEQ ID NO: 272799 - DNA, 725 bp, Homo sapiens
  misc_feature: GYAE6OF01DMTEX.47.76.G10.1.454.CMB.1.raw
  modified_base (199)..(199): a, c, t, g, unknown or other
  misc_feature (199)..(199): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccgggagtaagtttattttgacactagtctccagccaccctgtctttgctccgaggggaaangccaccctctcctgcagggccagtcagagtatagcagctaacttgcctggtaccagcaagaacctgggacaggcctcccaggtcctcctcactctatgtatcgacactaccgaacgcgggaccacgtcggcactccgaagacgtacggttcagggttcgacgtacggggttcgggtacgtacggggaactacggttaccttaccgtaccgttccgtaccctaacgtaacgttaccgacgtaccgaaccggtaccgtaacggtaccgtcccgtaagggtaaacccgtttacggttttaacggtaacctttttacgttaccgttaggtaccgtacgccgtaaggttcgtacggtttacgttccgtccggtaccctcccgttcttaccggttaccgggttccggggaccgggtaacgggtacgggtaggggtacggacgtaaccgtacggtaaaaccggttgttacgggtcggtacctaccgggacccttaccgtaggttaccctttcggttacccgtccgttacccgg

SEQ ID NO: 272800 - DNA, 654 bp, Homo sapiens
  misc_feature: GYAE6OF01D7UG2.47.76.G10.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccaccctgttctttgtctccgaggggaaangccaccctctcctgcagggccagtcagagtgttggcagctacttagcctaggtaccaanagaaacctggccaggcctccgaggcctcctcatctatgatcgccgtccaccgagggcctacgtcggtttcccaggtccctaggtttccgaggtcggctaggtcgccgtcgtaggggacaggtacgtttccaacgttcctacacctattaccaaacgtcgtccccttaggacctacggttaccgttaggtaagttacgtttttcgaccgtttaagtttttacttaaccgttgttactaagtctaagttactactaagttaacgtcggacctccgtacctacccgttaccggaccgtaacgggaccacggtacgtaggaacgttaacgtaaaacggtaacgttgggtacggctacgaccctacgtacttcgtacgttaccttacctatcccgttacccg

SEQ ID NO: 272801 - DNA, 848 bp, Homo sapiens
  misc_feature: GYAE6OF01DRUAD.47.76.G10.1.454.CMB.1.raw
tcagagctcacgtacacgaccggtgctcgatttagtcactcatacagggggaggaactgctcagttaggacccagagggaaccatggaacgccccagctcagcttctcttcctcctgcctactctggctcccagtacttccgaccggagactatttgtttgacacagtctccagccctaccttgttctttgtcctaccgaaggggaaacgcgaccctacccttctcctggacgacgggcctagtacgaggtagttggttcggctacgcgttacgtacgcgtacggtaacaaacgaacgaaaccgtcggccacggtcctaccgacggtccttacctactacgttactagtcgtaactcgactacgttaccgaaacggtacgggacctacggtacggacctaaccttccccgaacggtacccgttaacgggttccgtaagggtcggtacgtagggtagtaccggttcggttaacggacgtacgtaccgttacctacgtacccttaccgaacttaacgtacgaaccgaccgtacgtaaccggtaacggaccgttaaccggtaaaggttaaacgtttaacgttttactaaacccgtttaatttttaacgtcgtaagggtcctaacggtacgtacgggtaacctaaacgggtaccgttaaaccgggtccgttaccccggttacttaccgggtttacccggtttacccgggggaacggggtaacccggggttaacgggaacgggggttacggaaaccgggttataaccggggtaaactaacccgggggttatcgggggttacctccggttaaacccggcctaaaccggttcttttaaccgtccgtttaccccgg

SEQ ID NO: 272802 - DNA, 647 bp, Homo sapiens
  misc_feature: GYAE6OF01AR50S.47.76.G10.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (479)..(479): a, c, t, g, unknown or other
  misc_feature (479)..(479): n is a, c, g, or t
  modified_base (531)..(531): a, c, t, g, unknown or other
  misc_feature (531)..(531): n is a, c, g, or t
tcagagctcacgtacacgaccggtgctcgatttagtcactcatacgagggggaggaactgcctcagttaggacccagagggaaccatggaagccccaggctcagcttctcttcctcctgctactctggctcccagattccgaccggagacatttgtttttgacacagtcttccagccacctgtctttgctcgaggggaangccaccgtctccgtgcgagggccagtccgngagtgttcggcagtcttacttagccctggtaccaaattacgaaaatcgtggccaggcctccgaggcctctcgattcctaagtcgaacgtcgacgtactccaaacgcggggtccacggtcgaccatccccgagtaccgtaggttccaggtcgacgagttcgagtcgtgggacctggtacttcgactcgacaccctatccgacgtcacgccgtagaccgtcgtagaagttcttttagaccgttagttttanacgttagtacgaagtacctaaacggttaactacgttcggtaaccctccggtnttaccggtacccgtttcgggaggtaacccgggtgtacgggtacgacgtaacggtacggaaacggttacgtgggttcgcgtttaacggctaaccgtagtttacgtcgttcgttaccc

SEQ ID NO: 272803 - DNA, 821 bp, Homo sapiens
  misc_feature: GYAE6OF01D0110.47.76.G10.1.454.CMB.1.raw
  modified_base (209)..(209): a, c, t, g, unknown or other
  misc_feature (209)..(209): n is a, c, g, or t
tcagagctcacgtacacgaccggtgctcgatttagtcactcatacagggggaggaactgctcagttaggacccaggagggaaccatggaacgccccagctcagcttctcttcctcctgctactctggctcccagactaccagtcggagtaagttgtgttgacacagtctccagccctaccttgttctttgtcctaccggaaggggaaancgaccctaccctctccgtggcgacgggccagtcaagattactcactccttactagcctaggtaaccaacgacgtaacctggtacacggtcctaccgaggtcctacctcgtaacttctaagttgaacgttgacctaacgtaacccgaaacggtaccgggaccctaacgtcggacctaacgtaccccaaaggtcgtacgggttacagggttacggacgtagggttcggggtacgtacggaactacgtaacctttccgaactttcccaaccgtacctaatccggaacgtccgtaacgacccttaaggacgttacccgttaaagggttaaccgtttacggttttacgtaactttttaacgtacgtggttacacggtactacgggtgttaccggtttagttcccgtcggttaccccttaccggtacccgttttcggtaaacccggggtttcgggggaaaccgggttaacggggtaacccggttaggggggtaacgtaaaccgttaaaaccgaaccggggttaaaaccccggtggtttacggggttaaccgggaccctacgggtaacctacccgtttaggttaacccgtttcgtttaaacccctcggtttaccccccg

SEQ ID NO: 272804 - DNA, 732 bp, Homo sapiens
  misc_feature: GYAE6OF01EISEB.47.76.G10.1.454.CMB.1.raw
  modified_base (206)..(206): a, c, t, g, unknown or other
  misc_feature (206)..(206): n is a, c, g, or t
  modified_base (712)..(712): a, c, t, g, unknown or other
  misc_feature (712)..(712): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagactatttgttttgacacagtctccacgccctaccctgttctttgtcctaccgaaggggaaancgccaccctctcctgcgaggtcagtcagagtgttgacagtctacttagtcgtacggtaacaaggaacgtaaacctcggaccgaacggtcctccgaggtcctctacgtagttcgtcgggtaatcggactacgacccgtaaacggccgggccgttcgacgggacctaccgtacccgacggtaccgtacggttacaacggtcggtacggtaacggttcgggggtacgtacgggaaacctcgtaacccgttcaaccttccgtaaccactactaccgacgaacgacgtaccgagtccggtactaaggtaacgtttatttacgacttttaagtttaacttaccgtgtaaccgtaagtaacccgtaaagttaacgtttcccgcgtacccgttcctaccgttacgttaccggttacggggaccgggttaacgaccggtagggacaacggtagtaaaccggtaacgtacggtgtaacggcttacgaaaccctcgttacggttactaccggtttanacccttcgttcccgtacccg

SEQ ID NO: 272805 - DNA, 644 bp, Homo sapiens
  misc_feature: GYAE6OF01EZB1F.47.76.G10.1.454.CMB.1.raw
  modified_base (370)..(370): a, c, t, g, unknown or other
  misc_feature (370)..(370): n is a, c, g, or t
  modified_base (509)..(509): a, c, t, g, unknown or other
  misc_feature (509)..(509): n is a, c, g, or t
tcagagctcacgtacacgaccggtgctcgatttagtcactcatacaggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggagtcgtgggggaggcgtggtccagccgttgggacggtccctgacgactctcctgtcgcacgcctcgtggtacttcaccttcagttactatactatgcacgtggtccgccgtaagttgacgaggacaacctgtggaatcgggtcttcgtatgcttacgtggtggtcnccgtaagacgactagtcgacgtacggtccgtccggaggtacggggtacctacgttaccacctactctaaccgaagaacgtaaagtcggaactaaacggtaccttaccgtttagtaacttacttaacaaagttcgaaacncgtacgtaggaacgtacgggaccgggtacgacgggtggttacgttaacgttagttacggtaggttaaaggaggtcgtacgtaccggtaaggttaccgggtaaaggtaacgggttaacgtttaagttaggtttacg

SEQ ID NO: 272806 - DNA, 603 bp, Homo sapiens
  misc_feature: GYAE6OF01A13Z9.47.76.G10.1.454.CMB.1.raw
  modified_base (198)..(198): a, c, t, g, unknown or other
  misc_feature (198)..(198): n is a, c, g, or t
tcagagctcacgtacacgaccggtgctcgatttagtcactcatacaggggaggaactgcttagttaggacccagagggaaccatggaagccccagctcagcttctcttcctcctgctactctggctcccagattccaccggagacatttgttttgacacagtctccagccaccctgtctttgtctccgaggggaaagngcccaccctctcctgcgagggccagtcagagtgttggcagctacttagcctggtaccaacagaaacctggccaggcctcccgaggcctcctcactctatgatcgcactaccaacgacgggccacgtcggacactccccagcccgtaggttcaggtcggcaggtgacgtcgtgggactgacttcactctacaccatcacgacacgctacgcgtacagtaacgttatttgacttactttatacgttgtacacgtcagtcggtaagaccgtaacgtccggtccttacctccgttaaccgtttcgggaccgggtaacgggtaccgtaggggtcggaacgtacgtaccgaacggtaccgtaacgtggtacggtcgtagtaccctaaccgtattcgttcgttccgttaccg

SEQ ID NO: 272807 - DNA, 750 bp, Homo sapiens
  misc_feature: GYAE6OF01DCG5Z.47.76.G10.1.454.CMB.1.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
tcagagctcacgtacacgaccggtgctcgatttagtcactcatacagggggaggaactgctcagttaggacccagagggaaccatggaagccccagctcagcttcctcttcctcctgctactctggctcccagattccgaccggagactatttgtttgacacagtcctccagccaccctgtctttgtctaccgaaggggaanacgtcccaccctctccgtgacgaggccagtcagtagtgtagactagcttacttagcgtacggaacaagacgaaaccgtggaccacggtcctaccgaggtccctccgtaccagtccgtagggaactcgactaacgacccgaagaccgggccacgnggaccaactccgagacccgtaaggttcaaggtcgacgtaggttgggaccgtagggacctagtacttaccgacttcgaccactagtaccagtaccacgacctagacgtaccgttaaggaatttacgttttgtaacgttaaggttttaacttacccggagttaacgacgtaacggtaaccgttaacgaccgtaaaccgttccggttaacccctacgtttaccccgggttaaccgggtttacccggggaccgggggtaaacgggtacccggttaaggggggtacccgaaagttacggtaaccgaaagggtaaccggttaaccgttagggtacccggctttacgaacccgaaacgttcgtttacttaccggtttacctcccggttaatttccccccgg

SEQ ID NO: 272808 - DNA, 671 bp, Homo sapiens
  misc_feature: GYAE6OF01BN114.47.76.G10.1.454.CMB.1.raw
  modified_base (196)..(196): a, c, t, g, unknown or other
  misc_feature (196)..(196): n is a, c, g, or t
  modified_base (234)..(234): a, c, t, g, unknown or other
  misc_feature (234)..(234): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccaccggagaagttattttgacacagtctccagccaccctgtctttgtctccgaggggaaancgcccaccctctcctgcagggtcagtcagagtgtgacngctacttacgtctaggtaccaagacgaacctggaccaggcctcccgaggtcctcctcagtcgtgggactgcctagtaccgaacgcggggcccgcgtcggaccactccccgaggcccgtaggttccaggttcggccgtaggggttcgggtacgacggggactacggttaccttctaccgttcctaccaccgtatccgagccgacgcccgtaaggacgtccgtagttaacgttacgtttcggactttacgttttaacttacgtacgttacgaacgtaaccgttaaaagttaacgttaccgtaccggtacccttcccgccttaccgtaccggtttccggggacggtacgggaccgagggtacgacgtagtacggaaacgcgttggtcgtctcggaccacgtagttccgttagttaccttcgaccgttcccgttcccgtac

SEQ ID NO: 272809 - DNA, 676 bp, Homo sapiens
  misc_feature: GYAE6OF01B3SV9.47.76.G10.1.454.CMB.1.raw
  modified_base (196)..(196): a, c, t, g, unknown or other
  misc_feature (196)..(196): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtcttgtctccgaggggaaancgccaccctctcctgcgagggccagtcagtagtgttggcagctacttagcctaggtaccaacagaacctggccaggcctccgagcctctacatctatgatcgactactacccaaacgtaccgggccctaacgttcgggacctaccgtcccgaacgtcccgtaacgggtttccgagggttcggactaagggtcggtacggtccgtagggaaccgtacgtaaccttccgaaccttcaaccctaccgtactcgaccgacgtacgtaccgtaacggacgtacgtaagtaacgttacgtttacggtacttacgtttaactttacgtcgtactacgtacgacggtacgtaacgaaccgtacgtacgtccttaccgtaccgttaccggttcgggacgggtacggaccccgggtaggtacggaggtacgtacggaacggacggtacgtcggtacggtacgtacgaccgtactacgtcgtccgttaccg

SEQ ID NO: 272810 - DNA, 794 bp, Homo sapiens
  misc_feature: GYAE6OF01AP8KM.47.76.G10.1.454.CMB.1.raw
  modified_base (202)..(202): a, c, t, g, unknown or other
  misc_feature (202)..(202): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagacttccaccggagacatttgttttgacacagtcctccagcccaccctgttctttgtctccgaggggaaancgccaccctctcctgccgagggccagtcagagtgtggcagtctacgtagcctggtaaccaacgacgaacctggaccgtaggcctccgaggcctccgtcactctataggactcgacactaccgaacgacgggacccacgtcggacctaactccccgaaggccccgtaagggttccaagggtcgaccgtagggtacggtacggtacggttagggaacctacgtaccgttaccgaaccttcctaccaaaccgtactacgaacggcctaacgacccttaagggaccggtaccgttaaggtaaacggtttacgttttaacgtaaccgtttaacctttttaacgtttaccgttacggttacgtaaacggtccggtaacggacccgggttttaaacggacccgtaaaccgggtttccggtaccccctttaacggttcccggtttaaacccgggtttacccggggaacgggggtaacccgggtaaacccgggtgggggttaaccggaacgttaaccggtaccggaaacgggtaacgtaccgggttacggtacggtacccgtacggacccgtaaccggttacgttcggttcggtttaaccc

SEQ ID NO: 272811 - DNA, 867 bp, Homo sapiens
  misc_feature: GYAE6OF01DDQN2.47.76.G10.1.454.CMB.1.raw
tcagagctcacgtacacgaccggtgctcgatttagtcactcatacagggggaggaactgctcagttaggacccagagggaaccatggaagccccagctcagcttctcttcctcctgctactctggctcccagattccaccggagactatttgttttgacacagtctccagcccacctgttctttgtctccgaaggggaaagacgcccaccctctcctgcgacgggccagtcagagtgttggcagcttacgtacgcctaggtaaccaacgaacgaaacctggaccagggcctacccgaggcctcctactactactatgtatcgacctaactacccgaaacgacgggacctacgtcggaccacgtcccgagtccgtaaggttcgaggtcggacgtagggtcgggtcgtacggggaactacggtacctttccgaccttccgtaaccaacctataccgacggacctacggtacccgtaggaaccgtcgttaaagggtaacgtttagtttttacggaacttttaacggtttttaacgttaacgttacggtaaccgtaaacggttaaaccgtttaaaaaccggttaaacgtttacccggtttacggaccccccgttttacggttaaccccgtttaacccgggtttaacccggggttttaccggggggaacccgggggtaaaccgggggttacccgggtaaaggggggttaaaccccggtaaacggtaaaccggggttaaaccggaaaaaacccggggttaacgggtttaccggggttacggggtacccgtttaaacccgggacccgttaaacccggttacgtttttaacccgttcggttttaccccttaaccgttaccccgttttaccccccg

SEQ ID NO: 272812 - DNA, 676 bp, Homo sapiens
  misc_feature: GYAE6OF01B2BA9.47.76.G10.1.454.CMB.1.raw
  modified_base (202)..(202): a, c, t, g, unknown or other
  misc_feature (202)..(202): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagactatttgttttgacacagtcctccagccaccctgttctttgtcctcgaaggggaaancgccctaccctctccgtgcgacgggccagtcaaggtagtgttggacagcttactgcctggtaaccaacgacgtaaaccgtggaccgaggccctcccgacggtccctaccgtcaacttcgtatggactcggactaactcccgaaacggtaccgggacccacggtcggaccacttccccgaacggtccgtacggttcaggtcggctaggtcgaggtcgtaggacagtacttacacctactcaccatcgacgacacgtaccaggactcgttaagaagtttctttacgactttactttagtactgtacagtcgtaggtactacgacctacgtccgtccttacgttcgtacccgggttacgggcggtaaccgggccggttaaggggtcgtaagtaaccgggttaccgaaagggacgttaaccggtggttacgggacccttacgggtaccctacgtaccgtttccggttactttccccgg

SEQ ID NO: 272813 - DNA, 635 bp, Homo sapiens
  misc_feature: GYAE6OF01AW1HN.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagcgccaccctctcctgccagggccagtcagagtgttggcagctacttagcctaggtaccaacagaaacctggccaggcctcccgaggcctcctcatctatgatgcactccaacgcggccacgtcggacacgtcccagccgtaggtcaggtcggacagtgacgtcgacgggacacgtacttcaccgtctaccacctataccgacgcacgtccctagaccgtaccgtagtaacgttacgttttaccgacttaaccttttattaaccgttgtacctagccgtacggtacgtaacgtacctaacggttccggtcccttacgttaccgttaccggtttccggggacggggtaacggtaccggtacgggtacggtaacgtacgtcgtaacggtaccggtaacgttcggtacggtaccgtacgtacccgaacgtcttccgtgttaccg

SEQ ID NO: 272814 - DNA, 668 bp, Homo sapiens
  misc_feature: GYAE6OF01BI0LK.47.76.G10.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagagctcacgtacacgaccggtgctcgatttagtcactcatacaggggaggaactgctcagttaggacccagagggaaccatggaagccccagcgcagcttctcttcctcctgctactctggctcccagagaccactggagaaatagtgatgacgcagtctccagccaccctgtctgtctctccgaggggaaangccaccatcctctgtacgggccgtnagagtattagcatcaacttagcctggtaccagcagacgacctgggcaggctcccgaggcctcctcatctatgatcgccgtccaccgagggccctacgttggttaccccagtcctaggttcaggtcgcagtcgcgtcgtgggaactaggtacgtttccacgttcgtaccaaccgtattaccgaaacctcgtacccgttacgaccgtaacggttaccgtaaggtaaagttacgtttttacggaccgtttaagtttttaacttacgttacgttacaacgtaccgtaagttacttaaccgtaacttaaaccgtccgggtcccgttacctaccgtacccggttccggaaccgtaacgggtacctaaccggtaccggttaggtaaacgtaaacgttaaaacggtcgttacgggtacgaccgttacgaccctaaccgtcttcgttacgttcccg

SEQ ID NO: 272815 - DNA, 753 bp, Homo sapiens
  misc_feature: GYAE6OF01BGGHI.47.76.G10.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (300)..(300): a, c, t, g, unknown or other
  misc_feature (300)..(300): n is a, c, g, or t
tcagagctcacgtacacgaccggtgctcgatttagtcactcatacaggggaggaactgctcagttaggacccagagggaaccatggaagccccagctcagcttctcttcctcctgctactctggcctcccagactaccaccggagtaagtttattttgacacagtctccagccaccctgtctttgcctcgaggggaaancgccacctctccngccgagggtccagtcagagttgttagacagccttaacgttgtctaggtaaccaagacgaaacctggaccaggcctccgacggcctccnacgtcggtagggatcgactacgtaccaaacgtcggggcccctgtacgggaccacgttaccccgagacccgtaagggttcgacggttcgggaccgtaggggtttcggacgttacggggaacctaacggtcctttacccaccggttcctactaacccagttccgaagtcccgaacgtacccgttaaggaccgtacccgtaggtaaacgttcgttttaggacttaaggttttactacgtagtccgtaacgtaccgtaaacgtaactaacggtccgtaccttcgtaccgttacgttaccggttacggggtacccgggaacgggaccccgtaaggggtacgtaaccgtaggtaaacggtaaacggtaaccggttgggcgtaccgttccggaaccgttaaccgtacgttccgttacggtttaacccttacccttaccgttccccggttccccgtaaccg

SEQ ID NO: 272816 - DNA, 914 bp, Homo sapiens
  misc_feature: GYAE6OF01CQHFQ.47.76.G10.1.454.CMB.1.raw
  modified_base (213)..(213): a, c, t, g, unknown or other
  misc_feature (213)..(213): n is a, c, g, or t
tcagagctcacgtacacgaccggtgctcgatttagtcactcatacaggggaggaactgctcagttaggacccagagggaaccatggaagccccagctcagcttctcttcctcctgctactctggcctcccagattccaccggagactatttggttttgacacagtcctccagccacccttgtctttgtctccgaagggaaagacgccaccctntcctgcgagggccagtcagtagtgttggctagctacttagcctaggtaccaaacgaacgaaacccgtcggaccaacgggcccttaccccggaggtcccttacctaccattccgtaatcgattcggacctaaccgtacccgaaaaccggcgggtaccctaccggtcgggaccctaacccgttacccccgaacggacccgttaacgggtttaccgaacggttccgggacgtaaggggttaggacccgggttcggtaacgggggtaccctaaggtacccttttaaccgacctttacccttaacccgaaacccttacgtaccgaaacgtaccgttaaaccggtcccgtaaaggtaacccggtaaccggttaacggttaaaccggtttaaccgttttttaaggggtaacccttttttaacgttaacctttaggtacccgtaacgtaccggtaacgggttaccggtttaccgggttacgttttacccggtccgggttaccccccgtttcccgggtccgttttaccccggttaaacccgggtttcggggggtacccggggaaacccggggttaaaccggggtcgggggtttaaacggaccggttaaaccgtaaacccgggaaacccgggtttaacgggtcggttcgggtacccgttaccggtacccttaacgtacggtttcccgttaaaccggttccctttaaccccg

SEQ ID NO: 272817 - DNA, 743 bp, Homo sapiens
  misc_feature: GYAE6OF01DWB4O.47.76.G10.1.454.CMB.1.raw
  modified_base (195)..(195): a, c, t, g, unknown or other
  misc_feature (195)..(195): n is a, c, g, or t
  modified_base (468)..(468): a, c, t, g, unknown or other
  misc_feature (468)..(468): n is a, c, g, or t
tcagagctcacgtacacgaccggtgctcgatttagtcactcatacaggggaggaactgctcagttaggacccagagggaactatggaagccccagctcagcttctcttcctcctactactctggctcccagattccaccggagacatttgttttgacacagtctccagccacctgttctttgctccgagggaagngccacctctcctgcgagggccagtcaggagttggttggacagtcttacttacggccttaggtaaccaataacggaaaccgtggacccaggtccgtacccgacggtccttccgtacacgttcctaatcggagttcgacctaactacccgaaacgtacgggaccctaacgtcggaccacctacccgacgtaccgtacggttacgacgggttggaccgtaggtggtacggtcgtaggggactacggtaccttacgtactaccgtaccaaccgttanaccgtacgcctaacgtcgtaacggcgtaccgttagggtaatttacctttacggactttacgtttaactacgtttacgcgtagtacgtacgtaccggttagtaaccgtcgttacggtccttacccgttaccggttacggttccggggaaccggggtaacggggtccgtaagggggtcgtaaacgtaccgttacggaaaccgggtaacgttaacggttgggtacgtacccgtacgggtaacctaccggtatttacccggttgttacctttaacccgg

SEQ ID NO: 272818 - DNA, 722 bp, Homo sapiens
  misc_feature: GYAE6OF01CVQF8.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaacgcccagctcagcttctcttcctcctgctactctggctccagactaccaccggagtaagttattttgacacagtctccagccacctgtctttagctcgaggggaaancgcccacctctcctgcagggccagtcaagtatacttacactcctaacttacgcctaggtaccagtcaagagacctggggacacggcctaccgacggcctcctcacttacctatgtaactcggtacctccgaaccgacggggccctaaccggtttccggtttacccacgtccgttaaggttccgaggttcgggacctaggtccggaccgttcgtacggggacgtacgtacgtttcaacctcgttacccaacccttataccgaaaccgtacgccgtaagtcctaacgtcttaacggtaagttacgtttttacggacgtttaacgttttaactttaccgttggtacctaagggttacctaagttaactacgtaacttaaccggtcgggtacctacccgtccgttaacccggtttccgggaaccgtaacggggtaaccacggtacggtaggtaaacgtaacgttaaacgaccgtgggtacgtctaacggccaacgtctacgtttacgtcctttaactccgttcctaacccg

SEQ ID NO: 272819 - DNA, 853 bp, Homo sapiens
  misc_feature: GYAE6OF01EQSDS.47.76.G10.1.454.CMB.1.raw
  modified_base (259)..(259): a, c, t, g, unknown or other
  misc_feature (259)..(259): n is a, c, g, or t
tcagagctcacgtacacgaccggtgctcgatttagtcactcatacaggggaggaactgctcagttaggacccagagggaaccatggaacgccccagctcagtcttcctccttcctcctgtcctactctggcctcccagacttccaccggagtactattttgttttgaacactagtcctccacgccctacccttgttctttcgtcctaccggaaggggaaagacgccctaccctctccgtggaccgacgggccagtcagngttggtcgcagtctactacgccgtaggtaaccaacgaagaaacccgtcggacccgacggtaccctacccgacggtacccttcctactaacgttactaagttcgtagtacgactaaccttaacccgaaccggtacggtacccgtacgcggtaaccaccgtaccccgaagtcccgtaaggttccaacgggtcggacgttacgtaggtaccggttggtacgggacctaacggtacctttacccaacgtcccgtaacctaacccgtaatacccggtaacggtacctaacgacccggtaaacgcggttaaaccgttaggttaaacctttaacggtttaaccgtttaacgtttaccgttttaacgtcgttaacctacgggtaaccgtaacgggttcggtttacggtaccggtttcccggttaaccggttccccggttaccgtaccgtttcccgggttaaccgggtttccggggaacccgggttcggggtaaccggtaacggggtagtaaaccgtaaaccgttaaccggtaaaacggtgggttccgttaaccgggtcctaaacccggtcccaaacggttattccggttcgttacccttacg

SEQ ID NO: 272820 - DNA, 540 bp, Homo sapiens
  misc_feature: GYAE6OF01ECUVR.47.76.G10.1.454.CMB.1.raw
  modified_base (427)..(427): a, c, t, g, unknown or other
  misc_feature (427)..(427): n is a, c, g, or t
  modified_base (498)..(498): a, c, t, g, unknown or other
  misc_feature (498)..(498): n is a, c, g, or t
  modified_base (533)..(533): a, c, t, g, unknown or other
  misc_feature (533)..(533): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctactagcctggtaccaacagaaacctggaccaggcctcccgaggcctcctcatctatgtatgcactacccgaacgacgggcccacgtcggaccacgtccccagcccgtaggttcaggtcggcaggtgagtcgtagggactacggtaccttcactccgtacaccatcgagcacgcccgtagacgctagaagtntttgacttactttattactgtacagctagtcgtagctacgtcggctcgtactcgttcggacggacggacgngggtgagagtacgagacgacgtggtgctcgacacntcgtgtc

SEQ ID NO: 272821 - DNA, 866 bp, Homo sapiens
  misc_feature: GYAE6OF01AR9ZJ.47.76.G10.1.454.CMB.1.raw
tcagagctcacgtacacgaccggtgctcgatttagtcactcatacagggggaggaactgctcagttaggacccagagggaaccatggaacgccccagctcagcttctcttcctcctgctactctggctcccagattcccaccggagactatttgttttgacactagtcctccacgcccacccttgttctttgtccgtaccggaaggggaaacgcgcccaccccttcctccgtggacgacgggccctaggtcgaggtagttggttggcagtcttacgttacgtaccgtacggtaaccaaacaacggaaacccgtccggacccgacggcccgtacccgacggtccctcctacgtacttacgtagtacgtactcggtacctaacctacccgaaacggaccggggtccctaacggtcggaccctaaccgtccccgacggtcccgttaggttacgacggttacggacgtaggtacggtacggtacggtacgggtaactaccgtacctttacccacccgttcgtaaccccacgtaccgtaccgacgaccgaccgtaccgtaacggaccggtaacccgttaagttaaccgtttcgtttaccgtaactttacgttttacgttacgtccgttacgtacgggtacgtaacggtacccggtaacgtacccgtaaccggttccggtaccctttaacccgggtacccgttttacccggggttccgggggtaaacccggggtaccggtaaccggggttaggggtaccggtaaacgggtccggtaaaccgggtaaccgggtaaccggttaccgggttacgggttccggtaaccggtacccggtacccttacccggttacttcccggtttaccgtttacccg

SEQ ID NO: 272822 - DNA, 710 bp, Homo sapiens
  misc_feature: GYAE6OF01DWZVW.47.76.G10.1.454.CMB.1.raw
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
tcagagctcacgtacacgaccggtgctcgatttagtcactcatacaggggaggaactgctcagttaggacccagagggaaccatggaagccccagcgcagcttctcttcctcctgcctactctggctcccagataccactgggaagaaatagagatggacgcagtcctccacgcccaccctgtctgtgtctcgaggggaancncccacctctcctgcgacgggcagtcagtagtatacgcagactaacttacgccgtacgaccagacgaacgaaccgtggcgacgcctccgagtcctctctactacgtgtggacgcacctacccgaccggacgggtaccctacggtacgtacctcccgaagcccgttaaggttcgaggtcggacgtgggtcgggtacgtagggactaggtacgtcctaccgtacgtacccacgtacgtaccgaacgccgacgtccgtcggtacgtacgttcgtaagttaacgttttacgtttagttaacctttaaattttaccgttacgttaccggttacgtaacgtaaccgttaacgtaaacgtttaacgtaacccgttccggtaccgttacccggttaccgttaacccgggaacgggtaacgaccggtaacgtaacgggtacgtaaaggtttaaaccgtaaacggaacggttcggcgtaacgtacaccggtacttagtaccgtttcgttacgttaccc

SEQ ID NO: 272823 - DNA, 579 bp, Homo sapiens
  misc_feature: GYAE6OF01A03R8.47.76.G10.1.454.CMB.1.raw
  modified_base (195)..(195): a, c, t, g, unknown or other
  misc_feature (195)..(195): n is a, c, g, or t
  modified_base (241)..(241): a, c, t, g, unknown or other
  misc_feature (241)..(241): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (449)..(449): a, c, t, g, unknown or other
  misc_feature (449)..(449): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagccaccctgtctttgtctccaggggaaangcccaccctctcctgcagggccagtcagaatattcactcctattancctggtaccaacagaaacctggtcaggctcccaggctcctcatctatgatgcatccaacagggcccactggcactcccagacctaggttcaggtgctaggtgggtctgggacngacttcactctcactancagcagccttagngtaccgtagaacgtacttttggaacttttataccttgtaccagctaggtcgttagacgtttccgnggccccttccggcttaccgtacggtttccgggaccgggagggtacccgaggggtggaacgtagttaaccgaaaccggtagtgggtcggacgttcggacctaccgtatccgttcggttcttcccgtaaccg

SEQ ID NO: 272824 - DNA, 914 bp, Homo sapiens
  misc_feature: GYAE6OF01AXEDQ.47.76.G10.1.454.CMB.1.raw
  modified_base (324)..(324): a, c, t, g, unknown or other
  misc_feature (324)..(324): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagtattccgaccggagactagtttgttttgaccacagtctccacgcccacccgttgttctttgtccgtaccgaggggaaacgcgaccctaccctctcctgccgacggcctagccaggtagtggtgctagtcctacgttacgcctggtaaccaactaacgaaccgtcggccgtacggtcctacccgaggccttccnctacttcgttatggtaactcgaacctaaccgtaccgaaaccggcggggtccctaacgtccgggtacctaacccgttaccccggaggtacccgttagggtttaccgaacgggttcggaaccgttacgggttacgaccggttaccgggttaacggggaacccgtaccgggttaacctttccccgtaaacccggttttcctaaacccgtaaccctacgttccgaaaccggtcccgtaaccggtaacccgtaaccgggaccccggtttcccgtaaaggttaacccgttttacgttttacccgaaccgttttaacgtttttaaccggttacgtacggtttaacccggtaacgttaccggtaaccggttaacccgggtaacggtttcccgtaacccgggtttcggtaacccccgtttacggtttaccccggtttacccggggttaacccggggaaccggggtaacgggttcccggggtaacggggttaccgggtaccggttaacggtaaaccgggttacgggaacccggttacggtaccggggcgttaaaccggtcccggttacccaacggtttcttcccgtttcgttaacccccg

SEQ ID NO: 272825 - DNA, 709 bp, Homo sapiens
  misc_feature: GYAE6OF01D3G35.47.76.G10.1.454.CMB.1.raw
  modified_base (324)..(324): a, c, t, g, unknown or other
  misc_feature (324)..(324): n is a, c, g, or t
  modified_base (431)..(431): a, c, t, g, unknown or other
  misc_feature (431)..(431): n is a, c, g, or t
tcagagctcacgtacacgaccggtgctcgatttagtcactcatacaggggagaactgctcagttaggacccagagggaaccatggaagccccagctcagcttctcttcctcctgctactctggctcccagattcccaccggagacattgttttgacacagtctccagccaccctgtctttgtctccgaggggaaagcgcccaccctctcctgcgagggccagtcagagtgtggcagctacttagcctggtaccaacagaaacctcggaccgaggcctacccgaggcctccgtcaactcttaatgacttgacctactccgaaacncggcctacgtggaccactcccacgccgtaggttaccaggttcgggactacggtgtacggtacgttcgggaactcggtaaaccttccgtacccttctaccaacccttnaccgaacgctaacggaccctaagggtaccaccgttaacgtaaagttcgtttttaacgaccgttttactttttaacttacgttaccgggtacctaggtacgtacggttaccgggtaagacccgtaaccggtcggtacccttcccgttttgtaacccccggttttcggggacggggtaaacgggtaacccgggtaggggtcgggtaaaccgtagtacggacccgggtaacgttacggtggttacggtactacgcccctaagtctttacgtcgtttaaccc

SEQ ID NO: 272826 - DNA, 687 bp, Homo sapiens
  misc_feature: GYAE6OF01C857B.47.76.G10.1.454.CMB.1.raw
  modified_base (231)..(231): a, c, t, g, unknown or other
  misc_feature (231)..(231): n is a, c, g, or t
  modified_base (362)..(362): a, c, t, g, unknown or other
  misc_feature (362)..(362): n is a, c, g, or t
  modified_base (522)..(522): a, c, t, g, unknown or other
  misc_feature (522)..(522): n is a, c, g, or t
  modified_base (643)..(643): a, c, t, g, unknown or other
  misc_feature (643)..(643): n is a, c, g, or t
tcagagctcacgtacacgaccggtgctcgatttagtcactcatacaggggaggaactgctcagttaggacccagagggaaccatggaagccccagcgcagcttctcttcctctgctactctggcctcccagacgaccactggaagaaatagtgatgacgcagtctccagcccaccctgtctgtcctcgtccgaaggggaacacgcccaccatctccgtggtacgggccgtnagtagtatagcatacaagtgcctgtaacagcgaagacgaccgtgggacacggcctaccgacgtcctccgactaagttctaacgtggaactcggaccgtacccaccggacggtcctaacgttccggttaccngacccgtaggttcgaggttcggacgtaggtcgtccgtacggtacggtaacgtacgtacgttctaacctcgtacccgaactaccgttacaaaccgtccgtcccttaggacccaggtttaccgagtaaagtttcgtttaccgatttaagttttaacgttcgngttaacgacgtactagttaacgtctaaacggtttacctccgggtacctacgttaccctacgggttcccgaaacgtaacgggtaccaccgggtagtagggaaacgttaaaccttaaacgggngttcgggttaacgcctacgaccctattaccgcgttcgttaaccc

SEQ ID NO: 272827 - DNA, 713 bp, Homo sapiens
  misc_feature: GYAE6OF01CIUMJ.47.76.G10.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
  modified_base (486)..(486): a, c, t, g, unknown or other
  misc_feature (486)..(486): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagactatttgttttgacactagtcctccggccaccctgttctttgtctccgaaggggaanacgccaccctctcctgcagggccagtcagagtgttggcagtctacttagcctggtaccaanacgaaacctggccaggcctccaggcctcctanactctatgaatcgacacgtaccaaccgngggaccctaacgtcggacctaactccccgacgacccggtacggttaccagggttcggaccgtagtgggacgttcgggaggactacggtacttaccgtacttccgtaccaacctagtaccgcgtaacgacgtaccgtaaggcgtacccgtaaggtaaacggtttntttttaacgaccgtttaacttttaagttaccgttagtaccgtacgacggtaaacgtccgttaacggactaacgtccggtacccttacgtaccgttacggttccgggacgggtacgggaccgtaggggtacggacgtaaggtaccgaacggtacccgtaaaggttcgggtaccggtagttaccggtaaccgtaccctaagtttcccggttacgtttaccgtttacccg

SEQ ID NO: 272828 - DNA, 810 bp, Homo sapiens
  misc_feature: GYAE6OF01A16O6.47.76.G10.1.454.CMB.1.raw
  modified_base (177)..(177): a, c, t, g, unknown or other
  misc_feature (177)..(177): n is a, c, g, or t
  modified_base (206)..(206): a, c, t, g, unknown or other
  misc_feature (206)..(206): n is a, c, g, or t
tcagagctcacgtacacgaccggtgctcgatttagtcactcatacaggggaggaactgctcagttaggacccagagggaaccatggaagccccagctcagcttctcttcctcctgctactctggcctcccagacttccaccggagactatttgttttgaccactagtctccagcccnccctgttctttgtcctaccgaggggaaancgcccaccctctccgtgcacgggcccagtcgacgtaggttgttacggcaggtccttaacgttacggcccgttagggtaaacccctaaacgaacggtaaacccgttcgggacccaaggggtccccttaccccggagggtacccttccctactacgttaccttagtcggaacttcgacctacgttaccccgaaacggtccggggtacccaacggttcggacctacccgtccccgacggtcccgtagggtttccagggtccggacgtaggtcggtacggtcggtacgggaacctacggtacttaccgtacgtccctaaccacctacgtacgacgtacctacggtaccgtaggaccgttcgttaaggtaagttcgttttacgacttaactttttagtacgtcgttacgacgtaccgtacggtacgtaacgtccgttaaccggtccgttaccgttacctaccggtttacgggttaccggggaccggggtaacgggtcccgggtaaggggtcggtaaagggtacctaccgggaacggttaacccggtacgggttacggtccggtaccgtaccggttaccctaacccgttacgttccggttcctttaaccg

SEQ ID NO: 272829 - DNA, 761 bp, Homo sapiens
  misc_feature: GYAE6OF01B10UX.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagacttccaccggagactattgtttgacacagtctccagccacctgtcttgtctcgaagggaaagacgccaccctctcctgcgagggccagtcagagtgttggcagctacttagcctaggtaaccaagagaaacctgggacccaggcctacccgaggtcctcctacgaattcctaagtggtaactcgcaactccaaacgacgggccctaacggttcggacctaactccccgaaggtacccgtaagggttttaccaacgggttcgggaccttaaggtgggtaacggtcgtacggggactaacggtactttacccgaacttccctaacaacccgtaattccgaacgtcgaacgtccgttaacggacgtaccgttaggtaaacgttacgttttacgactttaaccgttttattaacgttcgtactaacggtacgttaaaacgttaaacgttacggtccggtaaccccgttccggtaccttaccgtaacccggttttacgggggaccgggtaacggggaaccggtaagggggttacgaccgttaaacggtaacgggtaaaaccgacgttacgggtacgggtacccgtcgtaaccccgtaccgtacttacccgtttcgttccgttttaccgtacccg

SEQ ID NO: 272830 - DNA, 640 bp, Homo sapiens
  misc_feature: GYAE6OF01AW0D2.47.76.G10.1.454.CMB.1.raw
  modified_base (198)..(198): a, c, t, g, unknown or other
  misc_feature (198)..(198): n is a, c, g, or t
  modified_base (413)..(413): a, c, t, g, unknown or other
  misc_feature (413)..(413): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagcccaccctgttctttgtctccgaggggaancgccaccctctcctgcgagggccagtcagaatattcactcctacttagcctagtaccaacacgaacctggtacaggcctcccaggccttcctacattctatgtatgacactaccacgacggcccacgtggcactcccgagacctaggtcaggtcgacgtacggtgggtcgtgggaacctagacgtttcaccttcctaccgaacctataccgaacncgtccgtcgacgtagtccgtaagtaagttacgtttttacgactttaagttttacgttactacgttacacggtatacgttaatcgtaattacgtcggtacctcgtacccgtaccgttaccggaccggtaacggacctaacgtacgtaggaaccgttaacgttaaaccgcgttggacggtcgtaacgtccctaacgtacgttccgttacttccttgtaccgttcccccg

SEQ ID NO: 272831 - DNA, 803 bp, Homo sapiens
  misc_feature: GYAE6OF01D1D5A.47.76.G10.1.454.CMB.1.raw
  modified_base (190)..(190): a, c, t, g, unknown or other
  misc_feature (190)..(190): n is a, c, g, or t
  modified_base (308)..(308): a, c, t, g, unknown or other
  misc_feature (308)..(308): n is a, c, g, or t
  modified_base (711)..(711): a, c, t, g, unknown or other
  misc_feature (711)..(711): n is a, c, g, or t
tcagagctcacgtacacgaccggtgctcgatttagtcactcatacaggggagctctgggagacgagcccagcactggaagtcgccggtgtttccattcggtgatcatcaactgaacacagaggaactcaacctatgggagttttgggctgacgtcgttgggtttttcctcggtttgcttacgttttaggnggtgttccagtcggtcagggtgcctaggcgttagggtcgggagggtccgtggggggacgtccggtggtcccgtagggtcccgttggggaccggttccccgtagacgcctttcgtaccnggttacgcctagtcctccgtgtacttacctaccttacgtacttaacttacgtacctagttcggtccgtccggtccgggtccgtaccggtaacggtccggaccgaggggtacggtaacggggtcggtagggttagggctttaagggggtactacgtaaggttaattacgtagtaaggttaggaacgtacgacggtaccaacgtaacgttactaacaacgtacgtaaccgttcggtaaacgggtacccgaacgggttacgtacccggtaacgttaaccgtcccgtaaccgtacgtaacccgtaacgttaaacgttaaaccgggtaaatcccggaaaaacggttactaacgtacgttaacgtacgtaccgtaaactaacgtaaacgacggtaaccgtacgtaacgnggaaccgtggtaaaacggtacgtaccggtacgttacggttcggttaacgttacggttgaacggttacggaaactggaaacgttggaaacggg

SEQ ID NO: 272832 - DNA, 603 bp, Homo sapiens
  misc_feature: GYAE6OF01BG3XO.47.76.G10.1.454.CMB.1.raw
  modified_base (194)..(194): a, c, t, g, unknown or other
  misc_feature (194)..(194): n is a, c, g, or t
  modified_base (307)..(307): a, c, t, g, unknown or other
  misc_feature (307)..(307): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
  modified_base (524)..(524): a, c, t, g, unknown or other
  misc_feature (524)..(524): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgagggaangccaccctctcctgcagggccagtcagagtgttggcagctacttagcctggtaccaacagaaacctggaccaggcctcccgaggcctccgtcatctatgatgcatccgaacgngggcccagtcggcacctccacgcctaggtcaggtggctaggtcgacgtcgagggacagtccttcacgtccacaccgntaccngaccacgcctagacgccgtagaaacgtttntttacgacctttagttttattaccgtagtacgcgacgtaggtaccgtacaccgtaacgtccgtaccttacgtccgttacggttccggacggggtaacggtcgggnggggtaggtaccgaggttaccgacggaacggtacgttcgggtagaccgttcggacccaccgttgttccttggttacccc

SEQ ID NO: 272833 - DNA, 888 bp, Homo sapiens
  misc_feature: GYAE6OF01EV0MR.47.76.G10.1.454.CMB.1.raw
tcagagctcacgtacacgaccggtgctcgatttagtcactcatacaggggaggaactgctcagttaggacccagagggaaccatggaagccccagctcagtcttctcttcctcctgctactctggctcccagtacttcccaccggagtactatttgttttgacacagtcctccacgcccacccttgtcttgtcgtccgtaccggaaggggaaaagcgcccaccccttcctcctggaccgaggggtccagtcgagtaagttagttacgccgaagtacctaacgtttacggccgttacggtaccaggtacaacggaaaccggtcggggactacggtccctacccgaggtcccttacccgtactaacttaccgttaaggttcggggtaccacctaacccgtttccccccggaaaccgggtaaccgggggttaccccttaaccgggttttaacggggttaaccccctacccccgggtaaacgggtaccccggtttaaggggttttccgaacgggttcgggacgttagggggtttaccgggggtcgtaacggggggtaactaaacggttacgtttcccgaaacgttttcccaaccgtaacccgacgttaccgaacggtaccgtacgtccgttcgacggttacgttaccggttaaggttaaacgtttacgttttagtaaacctttaacgttttaacgtttaaccgttacgttacgtacgtaagttaacggtttaacttaacgttaaccgtccggttaccctcggttacccgtacggaaacggtacggactaaccgggagtacggtaaaggtaacgttaaaaccgggtcttacgggtaggtacccgtacgaaccctaactcgttacttacggttccttcccgttacgttcccccg

SEQ ID NO: 272834 - DNA, 670 bp, Homo sapiens
  misc_feature: GYAE6OF01ARDCR.47.76.G10.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (531)..(531): a, c, t, g, unknown or other
  misc_feature (531)..(531): n is a, c, g, or t
tcagagctcacgtacacgaccggtgctcgatttagtcactcatacaggggaggaactgctcagttaggacccagagggaaccatggaagcccccagctcagcttctcttcctcctgctactctggctcccagacttccaccggagacatttgttttgacactagtctccagcccaccctgtctttgtctccgaggggaaancgccaccctctccgtgcgacgggccagtcagngtgttgcagtcttactagccgtaggtaaccaacgagaactcgtggccgacggtctcccgaggtcctcctcagttctatgactgaccactaccaacggaccggccctagtcggactaccgtacccgagtaccgtaggttcgacggttgacgtacgtggtacggtccgtagggactacgtacctttaccgaccttccaaccgacctagtaccaggtacccgacgtaccgtaaggaccgtacccgttaggaactttcgtttacggtaacctttaaaggttttcctagttcggtacacggtntaccggtacgtaacgacgtaccgtcggtaccttcgttaactcccggggttacggaacggcggggtaccgtagggggagtacggactacgggacgtaacgtacggttcggaggtacctccgagtccctagtccgttaccg

SEQ ID NO: 272835 - DNA, 564 bp, Homo sapiens
  misc_feature: GYAE6OF01CGXG9.47.76.G10.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
  modified_base (279)..(279): a, c, t, g, unknown or other
  misc_feature (279)..(279): n is a, c, g, or t
  modified_base (379)..(379): a, c, t, g, unknown or other
  misc_feature (379)..(379): n is a, c, g, or t
  modified_base (529)..(529): a, c, t, g, unknown or other
  misc_feature (529)..(529): n is a, c, g, or t
tcagagctcacgtacacgaccggtgctcgatttagtcactcatacagggggaggaactgctcagttaggacccagagggaaccatggaagcccagctcagcttctcttcctcctgctactctggctcccagattccaccggagacattgttttgacacagtctccagccaccctgtctttgctccgaaggggaaanacgccacccctntcctgccgacgggccagtcagagtgttggcagctattagctgaccaanagaacctgcaggcctccagctcnatcatgatgacatcaaacgcggccacgtgaccactcccgagccgaggttcaggttcggcagtcgagtcgtgggtacagtaccttcgactcctacaccganctagcagccagacacgtagaagtactttagactacgtttattacgtacgtcaacgtcgacgtacgtacgactaaccgtcggtacctacgttccgtaacgtttccgggacggacgggaccgagggtgaacgtagtccggaaggacgtacgnggtacggcttacgaccgaatcggttcttacgtccg

SEQ ID NO: 272836 - DNA, 685 bp, Homo sapiens
  misc_feature: GYAE6OF01BS9XU.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccgaccggagactatttgttttgacactagtcctccacgcccacctgttctttgtctccgaaggggaaagcgtcccaccctctcctgcgacgggccagtcgagtagtgtggacagcttacgtagccgtaggtaaccaacgacgaaccgtcggaccacgggccctacccgacggtccttccgtacacgttacctagtcgtactcgaccacgttacccgaacggaccggacctacggtcggacctacgacccgacgtaccgtagggttaccgaggtccggacgtagtcggtacgtcggacgggactacgtaccttcgaccttcaaccactacacggacgacgtacgtaccgtagaccgtacgtaagtaacgtttactttactacctttacttttacgtaacgtcgtactcgtacgtcgtaacgtacgtaacgtaacgtcggtacccttcgttaccgtacgggttccgggacgggtacgggtacggagggtcgaacgtacgtacgaacgtcggtacgcggtacggtctacgaccttaagtcttacgtcgttacc

SEQ ID NO: 272837 - DNA, 612 bp, Homo sapiens
  misc_feature: GYAE6OF01B6AOT.47.76.G10.1.454.CMB.1.raw
  modified_base (470)..(470): a, c, t, g, unknown or other
  misc_feature (470)..(470): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccacctgtctttgtctccgaggggaaagagccaccctctcctgcgagggccagtcagagtgttggcagctacttagcctaggtaccaacgagaaacctggaccaggcctcccgaggtcctcctcgattctatgatgacatccaacgacgggccacgtggacactccccgagtcccgaggttccgaggtcggacgtaggtgtaggtcgtagggactacggtaccttccgtaactcctacgacctataccgagccacgcctaagaccgtctagtaagtacgttttcgaacttacttttagttacngtacagcgtagacgtacgaactcgtcgtcctacgttacgtccggttcgggacgggaacggtaccggtagggtacggactacgtacggaacgtacggtacggtcggtactccggacgtacctaacgtcgttcgttcgttaccg

SEQ ID NO: 272838 - DNA, 762 bp, Homo sapiens
  misc_feature: GYAE6OF01A7B6I.47.76.G10.1.454.CMB.1.raw
  modified_base (196)..(196): a, c, t, g, unknown or other
  misc_feature (196)..(196): n is a, c, g, or t
  modified_base (321)..(321): a, c, t, g, unknown or other
  misc_feature (321)..(321): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagactatttgttttgacacagtctccagccacctgtctttgtctccgaggggaancgccaccctctcctgcgacgggccagtcagagttgtcggcagccttaacgttacgccgttacggtaacccaacgacgtaaaacccgtcggaccctagggtccctaccccgaggtcccttcccgtnacgttctagcgtatcggactacgtaccgaacggcggccctagtcggcctaactcccgaagtacgtacgggttccgaaggttcggactagggtgtaacggtcgtacggggaactaaggtccttaccgtaaccttccggtaaaccaccgttaacgcccggtaataccggtacgtaaccgttacggacgttacccgtaaggtaaacgttacggtttttccgaaccttttaaccgttttaccgttacgttaccggtacgtaacgtcgttacggtaccgttaacgtaccgttacgggtaccgtacccgttccttaccggttaccggtttaccggggacgggaacgggtaccggtaacgggttaggacgtacggtaccgaacgggtaacgtcggttacggccggttaacgtcggaacctaccggtttaccgttgttccccgtttacg

SEQ ID NO: 272839 - DNA, 810 bp, Homo sapiens
  misc_feature: GYAE6OF01EJUYP.47.76.G10.1.454.CMB.1.raw
  modified_base (147)..(147): a, c, t, g, unknown or other
  misc_feature (147)..(147): n is a, c, g, or t
  modified_base (250)..(250): a, c, t, g, unknown or other
  misc_feature (250)..(250): n is a, c, g, or t
  modified_base (318)..(318): a, c, t, g, unknown or other
  misc_feature (318)..(318): n is a, c, g, or t
  modified_base (791)..(791): a, c, t, g, unknown or other
  misc_feature (791)..(791): n is a, c, g, or t
tcagagctcacgtacacgaccggtgctcgatttagtcactcatacaggggaggaactgctcagttaggacccagagggaaccatggaacgccccagctcagcttctcttcctcctgctactctggcctccagtacttccaccggganactatttgttttgacactagtctccacgtcccaccttgttctttgtcctccgaaggggaaactcgccctacccttcgtccctgaccgacgggccagtcaaggngttcgttgcagtcttactacgccgttaggaaccaacgaacgtaactcggaccaccggtacctacccgnggacccttccgtactaacttccgttatacgtacgttcgaaccttaccaaccgtaaccgggccgggtaccctagttccgggaccttaaccgtcccccgaagtacccggttaaccgggttaccgagggttaccggaacgttagggtacgtacgggttacggaccgggtaaccgtacgttaaccgttactacccgttccaaacccggtactacgtagtacccgtactaaaccggttaccaacgggtacgttacccggttaaggtaaacttttacggtttcgtaacccctttaagtttttaaccgtagttaccggtccctaagtccggttaacggtacgtaactaccgtacccgttacgtcccttacgtacccggtttaaccgggtcgggaacgggtaccgggtacggtaccgggttaggaacgtaccggtaggtaacgtacggtacggttcgaggtcccgttacgaacccgtttancttttcggtaccgtttacg

SEQ ID NO: 272840 - DNA, 799 bp, Homo sapiens
  misc_feature: GYAE6OF01C2V3S.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctcggctcccagacttccaccggagactatttgttttgacactagtcctccacgcccaccttgttctttgtccgtaccggaagggggtaaacgacgaccctacccttcctccgtcggacggacgggcctagtacgaggtaggttcggttcggacctaggtacctttaaccgtttacggtacccgttacgggttaaacccaaacggaaacggtaaacccgtcgggacccgtacgggtacccttacccgacggtcccttcctaccgtacgttctaggttcggtcgtcctaccgtaccgaccggacggtaccctacggttacggtaccctcccggacgtacggttacggttacgcgggtacggacgtacggggtcggtcgggacggtaacgtacggttacgttacgtccgttctaccactcgtacacgcgacgtcgtagcgtacgttagtaggttatttcgtttataagttttacttacgttacgtagttacgtacgttataaggttaactacggttaaccgtccggtccgtaccgttacggttaccgggtaaccgggaaacgtaccggtacgttacggtaacgggtaacttaaacggtaccggtaggtacggtcgtaccacgggttaccaccgttacgttcctttacggttaccttaccggttaccttccccggtctaccg

SEQ ID NO: 272841 - DNA, 818 bp, Homo sapiens
  misc_feature: GYAE6OF01C241V.47.76.G10.1.454.CMB.1.raw
  modified_base (144)..(144): a, c, t, g, unknown or other
  misc_feature (144)..(144): n is a, c, g, or t
tcagagctcacgtacacgaccggtgctcgatttagtcactcatacaggggaggaactgctcagttaggacccagagggaaccatggaagccccagctcagcttctcttcctcctgctactctggctcctagattccaccggganactatttgttttgacacagtcctccagcccacccttgttcttttcgcctccgaaggggaaagcgacccaccctctcctgacgacgggccagtccgaggtagttggttaggcctaagtcttaaccgttacggccgttaggtaacccaaaacgaacgtaaaacccgttcgggacccaacgggtcccttaccccgagggtcccttaccctaccaacttcctagtacgtactacggacctaacgccccgaaaacggaccgggacccaacggttcgggacctaaccgttaccccgaacggtcccgtaaacgggtttccaagggttcggacgtaacggttggaacgtccgtaggggaacctaggtacctttccgaccttacgaccaacctatcgaacgaccaccggtacctaacggtaccgtaccgtaaggtaaacgtttacgtttttaccgtacgttttaacttttaaccgtttacgtttacggtactaacggttactacgggttaccgtaacgtaacccgttacgttacccggtccttaccgttaccgttacccggttttacggggaccgggtacggggttaaccggacgggggttacgtaacgacgttaccgtaacggaaacggttacggttacggtacggtacgtccggaactaccgtacgttccgttagttaccc

SEQ ID NO: 272842 - DNA, 747 bp, Homo sapiens
  misc_feature: GYAE6OF01AM2KL.47.76.G10.1.454.CMB.1.raw
  modified_base (198)..(198): a, c, t, g, unknown or other
  misc_feature (198)..(198): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (426)..(426): a, c, t, g, unknown or other
  misc_feature (426)..(426): n is a, c, g, or t
tcagagctcacgtacacgaccggtgctcgatttagtcactcatacaggggaggaactgctcagttaggacccagagggaaccatggaagcccagctcagcttctcttcctctgctactctggctcccagacttccaccggagactattgttttgacacagtctccagcccaccttgttctttgtcctacgaggggaanacgcccacctctcctggaccgacggtccagtcagtagttgtgcgagtctagttacgcctggtaaccaacgtacgaaccgtggccaggcctaccgtagcctaccncatcgtatgatcgaccactaccacgacggcctagtaccgctacnccgagtccgtaggtccaggtcggactaggtcgacgttgtacgggactaccgtattcccggacctaccgttacaacccgtnttaacccgacgtacgacgtacccgtacgtaccggtaccggttacggtaagtttacgtttaaccgttaacgtttaccttttaacgttacgtaccgttaacgacgttacggtacgtaacgttacggaacccgttacggtacccgttacccttaccggttaccttaaccgggttacccggggacgggttaaccgggaccgggtttaaccggggaggttaacgtaaccgggttaacgggaaccggttaacgggtacccggttcgggttaacccggccggttaaaccgaccttaccccggttagtttacccggtagtttaaccccg

SEQ ID NO: 272843 - DNA, 660 bp, Homo sapiens
  misc_feature: GYAE6OF01D719F.47.76.G10.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (278)..(278): a, c, t, g, unknown or other
  misc_feature (278)..(278): n is a, c, g, or t
  modified_base (335)..(335): a, c, t, g, unknown or other
  misc_feature (335)..(335): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagacatttgttttgacacagtctccagccacctgtctttgctccgagggaangccacctctccngcgaggccagtcagagtgtggcagctactacgctacggaccaacgaagaacctggaccacgggtcctaccgnggacctcctactattcctaatgtaactgtaccgactaaccggaacgacggcctacgngtaccacgtcccaggtacctgggttacaggtcgcgtacgtgacggtcgacggactacgtactacgtacctactacacacgtacgacgacacgtcgaacgctaaccgttaagtaaagttctttaccgtacttttaacttacgtttacgacggtgtaaccgtcgttaacggtcgtaacaaccgtttaccggccgttcctaccgttccggttaccgttacgggggaccggtaacgggttacggaaggggttcaaacgtcgtaccggtaaaggtaaccgtggtcggtaaccgtccgggtcaacctaccgttattcccgtagttaccccg

SEQ ID NO: 272844 - DNA, 638 bp, Homo sapiens
  misc_feature: GYAE6OF01EMYOG.47.76.G10.1.454.CMB.1.raw
  modified_base (301)..(301): a, c, t, g, unknown or other
  misc_feature (301)..(301): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagagctcacgtacacgaccggtgctcgatttagtcactcatacaggggaggaactgctcagttaggacccagagggaaccatggaagcccccagctcagcttctcttcctcctgctactctggctcccagacttccacccggagactatttgtttttgacgctagtctccagcccaccctgtctgtctactccgagggaaagacgcccaccatcctccgttgtacgggccgtcagagttattagcatctaacttgccgtgtaccagtcagagaccgtggacagctcccgagcctccgtnatctagtgtacgtcgccgtcccgacggtacgggcctacgtttccgttccccagtccctaggtttaccaggtccgacggtaggttcgacgttcggtacggatacggtagttccatcccgtaccaccgntaccacncgtaccncgctagtcgtagtaacttgttcgattatttaccttagttcgtacgtagtacattactacgtactacgtcgtacccgtctacccgtaccgttccggaaccgtacggtacaccggtacgtaggaacgtaaaccgttacgtaaccgtggtacgacgttacggacctacccggttacttcgtacgttcttaccgttcccg

SEQ ID NO: 272845 - DNA, 870 bp, Homo sapiens
  misc_feature: GYAE6OF01DY5I7.47.76.G10.1.454.CMB.1.raw
  modified_base (227)..(227): a, c, t, g, unknown or other
  misc_feature (227)..(227): n is a, c, g, or t
tcagagctcacgtacacgaccggtgctcgatttagtcactcatacagggggaggaactgctcagttaggacccagagggaaccatggaagccccagctcagcttctcttcctcctgctactctggcctcccagtacttcccaccgggagactattttgttttacgacactagttcctcccacgccctacccttgtttcctttcgtaccgtaccggaagggggaaacnccgccctaccccttctccgtacggccgacgggtaccacggtacgacggtaggttcggttcggactagtaccttacgttacggccgttacggtaaccctaaacgaaccggtaaaccgtcgggacctacggtccctacccggaacggtccctccttacatttcgtagtgtactacgacctacgtaacccgaacgggaccggacccgtacgtcggaaccctaccgtacccgtaaggtaccgttaagggttccggtaggtccggggtaaccggtcggggtttagggtcccggtaacgggtacctaccggttacctaccgttaccctaccctaccgtaaccgtacgtcctacggtaacccgtacgtacggtacgaccggttaccgtaagttaaccgttttacgtttaacggttacttttaacgtcttaggtaccgtatcggtaccgttagtcgttacgttacccgtaccggttcccctcggtttcccggttaccgttaccggggtagggggtaacccggtgggggtaacccggttaggggtacggtaaaccttaaaccgggaaccggtaacggtcggttcgggccggttaccgtaccgacccgtttaaacggttctttacggtttaccgttcccgtacctttaccccg

SEQ ID NO: 272846 - DNA, 885 bp, Homo sapiens
  misc_feature: GYAE6OF01AWGDV.47.76.G10.1.454.CMB.1.raw
  modified_base (201)..(201): a, c, t, g, unknown or other
  misc_feature (201)..(201): n is a, c, g, or t
tcagagctcacgtacacgaccggtgctcgatttagtcactcatacaggggaggaactgctcagttaggacccagacggaaccagtggaagccccagcgcagcttctcttcctctgctactctggctcccagataccagtcggagaagttgtgttgacacgagtctccagccaccgtgtctttcgctaccgaaggggaaacncgccctaccctctccgtgacgtacgggcctagtcaagaattactcacttccgtacttacgccgtaggtaccaaacgtaacgaaaccgttggtaccgaacgggccctacccgtaggcccttaccgttcaacttccgttaagtcgaacgttaccggacctaaaccgttacccgaaaccggacggggttaaccccaacggttccgggaaccctaaccgtacccccgtaaagggaacccgttaaggggttaccgaacgggttcggggaccgttagggggttaccggggtttacgggaacggggaaacctaacggtaaccgtttaacctaccgttacccgtacccgtaaccttacaccggtacgtaaccgtacgtacccgttaaaggcccgttaccgtaacggtaaaggtttacgttaacgggtttaaactttacttacgtccggtacttaccgggactacgggttacggtgggtaaccgtttcgtacccgggtcttcccgtccgttaacccggttaccgggttaacccggggtcgggaaccggggttaccggtaagggttaaccggggtaaacgtaaaccgtttaaccgggaaaacccggtttacggttcgggtaacgggttcccgtaaacggcccctttaaacgggttaccttttacggttacccgtttaacgttcccgttaaccgg

SEQ ID NO: 272847 - DNA, 765 bp, Homo sapiens
  misc_feature: GYAE6OF01CU80H.47.76.G10.1.454.CMB.1.raw
  modified_base (348)..(348): a, c, t, g, unknown or other
  misc_feature (348)..(348): n is a, c, g, or t
  modified_base (755)..(755): a, c, t, g, unknown or other
  misc_feature (755)..(755): n is a, c, g, or t
tcagagctcacgtacacgaccggtgctcgatttagtcactcatacaggggaggaactgctcagttaggacccaggagggaaccatggaacgccccagctcagtcttctcttcctcctgctactctggcctccagtacttccgaaccggagactattttgttttgactacacgtcctccacgccctacccttgttctttcgtcctacgaagggggaaacaccgccctacccttctccgtcgcgacgggccacgtacgaacggtgttggttcggacgtacgtcttacgttcgccgtacggtaccaacgaacgtaaccgtcggactacggcctccggacgtcctctacatntactgtctacgactacgaccgaacggaccggacctacgtacggcctaccgcccgacggacgtacggtacgtaggtcgacgtaggtcggacggttcggtacggtaactacgttaccttacgtacccttacgaccgtacctacgtaccgacgacgtaccggtacgacgtacggtaccgttaagtaacgtttactttaaccgtaccttttacgtttacttaacgtacgtacgtacgtacgtacgtaccgtacgtacccgttaccgttccgttaccgttccggtttccggttaccgggttaccggggaccgggttaaccggggtacgggtacgggtacggttaacgacggtaccggaacggtaaccggttccgggtacggtacggtacgtacgtaccctaccgttcccttnttcccgtccg

SEQ ID NO: 272848 - DNA, 852 bp, Homo sapiens
  misc_feature: GYAE6OF01ES26K.47.76.G10.1.454.CMB.1.raw
  modified_base (195)..(195): a, c, t, g, unknown or other
  misc_feature (195)..(195): n is a, c, g, or t
  modified_base (464)..(464): a, c, t, g, unknown or other
  misc_feature (464)..(464): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaanagccaccctctccgtgcgagggccagtcgagagtgttggcagtcttacgttacgccgtaggtaacccaaagacgtaaaccgtcgggaccacggtccctcccgagggtcctccgtactacttaccgtatacggtacttcggcctaaacttacccgaaacggtaccggggaccctaacggttcgggacctaacccgtccccgaagggtacccctaagggtttaccacgggttcggaccggtaggttagggaccggttacggacggggtaanaaccgggttaccttacctacccggtacccttaaccaaccgttacgttacaaccggtacctacggtaaccctaacggaccgtaaccggtttaaggtaaacttttacggtttaagggaacccctttttaacgttttaacctttaaccggttagtaacccgtacggttacccggaaacggttaccggttaaccggtaccgttaaaccggttcccggtacctttacccgtccggtttaccgggtttacgggaaccggggtaacgggtacgggtacgggggttaacgaacgggttaccgaacgggttaacgtaaaccccggggtggtttaaccgggcggttaccggtaacccttaccgaaccccttagtttcccgggtttaattacccccggg

SEQ ID NO: 272849 - DNA, 806 bp, Homo sapiens
  misc_feature: GYAE6OF01CK8JR.47.76.G10.1.454.CMB.1.raw
  modified_base (115)..(115): a, c, t, g, unknown or other
  misc_feature (115)..(115): n is a, c, g, or t
  modified_base (209)..(209): a, c, t, g, unknown or other
  misc_feature (209)..(209): n is a, c, g, or t
tcagagctcacgtacacgaccggtgctcgatttagtcactcatacaggggaggaactgctcagttaggacccagacggaaccatggaagccccagcgcagcttctcttcctcctnctactctggcctcccagactaccacgtggaagaaatagacgatggacgcacgtcctccacgccctacctgtctgtcgtcctacgaaggggaacncgccaccctctccgtgcgaggccagtcgacggtagtattacgactacgactaacgtcgaccgtacggtaacccagaccgaacggtaaccgcgggacctaaccggtcctaccgacggtccttacctactacgttacttacggtggtaccacctaccgtacccggaaccggccgggtacctaccgggttaccggttaccacccgtaaggtacccgtaaggttacggacggtacggacgttagggggttcgggtaaccgtacgggtacgtaaggttaccgtaccctaccgttaccgtaacctacctaacgttacggaccgtaccgtacccgtccgggtacgaccgttacggtacggttagttaaacggtttccgtttaacgtaacgttttaaacctttacgtacgttacgtacgtacgtaaacgttaactttaactaacccggttaccggttacgtaccccggtttacgtacccgggttaacgggacccggtaacgggtaccgtacgtaccgtaagggtaaccgttaaacggtaacgttaacgggtggttaccgacgttacgacccgttacctagggtttacccctttcgtcgttacccg

SEQ ID NO: 272850 - DNA, 837 bp, Homo sapiens
  misc_feature: GYAE6OF01EWFFN.47.76.G10.1.454.CMB.1.raw
  modified_base (568)..(568): a, c, t, g, unknown or other
  misc_feature (568)..(568): n is a, c, g, or t
  modified_base (671)..(671): a, c, t, g, unknown or other
  misc_feature (671)..(671): n is a, c, g, or t
tcagagctcacgtacacgaccggtgctcgatttagtcactcatacaggggagaactgctcagttacggacccagagggaaccatggaacgccccagctcagtcttctcttcctcctgcctactcgtggcctcccagtacttccgacggatactagtttgtttacgacacagtcctaccacgaccctaccttgttctttcgccgttaccggaaggggaaatccgtcccaacccgttctccgtacggacggaccgggtcctaagtacgaaacgtaatttacttccgtaccttacccttaacgttacgacccgttacgggaaaaccctaacgtaacggttaaccgttcggtaacgaccgggtccctccggacgttccctacctacgtaacttcgttacgtcgtacgtacgtaccctaacgtacccgaaacggtaccggacccttaacggtacgtacccaaccgtttaacccggaagttacgttaaccgtcggaacgggttccgacgggtacgggttacgggtcgaaacgggtacctacgtttaccgttaccaccgtcgtaaccacggttanccgtagaccctacggtacctaccggtaccgtaacgttacggtaacggtttcggtttacttaacgtttcgtaaccgtgtaaccgaggtacccgtaggtttccgnggtttaccgtcgtcccggtcccttacgttcctacgggttccggtaacgggcgggtaaaccgggtcgtaacggtaacgttacgtaaccggtaaacctacggttcgtcggtacgtacccgtacgtaccgtactacgtttacgtccgtactttaccgtcccgttacccg

SEQ ID NO: 272851 - DNA, 256 bp, Homo sapiens
  misc_feature: GYAE6OF02IA02P.47.76.G10.1.454.CMB.1.raw
  modified_base (226)..(226): a, c, t, g, unknown or other
  misc_feature (226)..(226): n is a, c, g, or t
  modified_base (250)..(256): a, c, t, g, unknown or other
  misc_feature (250)..(256): n is a, c, g, or t
tcagagctcacgtacacgaccggtgctcgatttagtcactcatacagggcagttccagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgcatctgatacgtgagctcngagcgggctggcaaggcgcatagnnnnnnn

SEQ ID NO: 272852 - DNA, 496 bp, Homo sapiens
  misc_feature: GYAE6OF02IAZ47.47.76.G10.1.454.CMB.1.raw
  modified_base (195)..(195): a, c, t, g, unknown or other
  misc_feature (195)..(195): n is a, c, g, or t
  modified_base (456)..(456): a, c, t, g, unknown or other
  misc_feature (456)..(456): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagagaccactggagaaatagtgatgacgcagtctccagccaccctgtctgtctctccaggggaaanagccaccatctcctgtagggccggtcagagtattagcatcaacttagcctggtaccagcagagacctggccaggctcccaggctcctcatctatgatgcatccaacgagggccactggcatcccagccaggttcagtggcagtgagtctgggacagcttcactctcacatcagcagcctagagcctagaagtatttgactacttttattactgtcagcagcgtagcaacgtgcctctctacgttcggacggacgggaccgnggggtagaggtatacgagacgaacgtgtggctcgctaccg

SEQ ID NO: 272853 - DNA, 256 bp, Homo sapiens; identical to SEQ ID NO: 272721
  misc_feature: GYAE6OF02GS68Z.47.76.G10.1.454.CMB.1.raw
  modified_base (252)..(256): a, c, t, g, unknown or other
  misc_feature (252)..(256): n is a, c, g, or t

SEQ ID NO: 272854 - DNA, 548 bp, Homo sapiens
  misc_feature: GYAE6OF02H5YFT.47.76.G10.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagcccaccctgtctttgtctccgaggggaangccaccctctcctgcagggccagtcagagtgttggcagctacttagcctggtaccaanagaacctggccaggctccaggcctcctcatctatgatgcatccaacagggccactggcatcccagccaggttcagtggcagtgagtctgggacagacttcactctcaccatccagcacgcctagacgcctagaagtatttcgctactttattactgttcagcagcgtagacaactcggtcctctccgtacgtttccgggacggacgggtaccgaggggtacggtacggtacgtcggaaggtaccggaacgttaggtgggtactacggcctaacccgtagttcccgtgttaccg

SEQ ID NO: 272855 - DNA, 506 bp, Homo sapiens
  misc_feature: GYAE6OF02FX8QZ.47.76.G10.1.454.CMB.1.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggccaggctccaggctcctcatctatgatgcatccaacngggccactggcatcccagccaggttcagtggcagtgagtctgggacagacttcactctcaccatcagcagcctagngcctgaagtatttgctactttattactgttcagcagtcgtgtagttctggcctccgcttctacttcgggcggaggccgtagggtcggaggactacgaaacgtaacgtggtgcgtgccactatctgtcc

SEQ ID NO: 272856 - DNA, 536 bp, Homo sapiens
  misc_feature: GYAE6OF02HEWZD.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtgcagtgggctgggacagcttcactctcaccatcagcagcctagacgcctgaagtactttaggtactttattactgtcagcagcgtgagttcgtggtcctccgctcgtacgtttcgggcggtacgggaccgaggggtagacgacgtacgaaacggtaacgtacggtaggcttcgcgtacctacgttcgttcgtaccttcattcccg

SEQ ID NO: 272857 - DNA, 494 bp, Homo sapiens
  misc_feature: GYAE6OF02HJS0N.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtatttgctactttattactgtcagcagcgtagcaactggcctctctacgtttcggcggagggaccgagggtggagagtcgagacgaacgtgtggctgcacatctgttc

SEQ ID NO: 272858 - DNA, 615 bp, Homo sapiens
  misc_feature: GYAE6OF02JHXAZ.47.76.G10.1.454.CMB.1.raw
  modified_base (303)..(303): a, c, t, g, unknown or other
  misc_feature (303)..(303): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacgngggccacgtggcactcccagccaggttcagtggcagtgagtctagggacaggacttcactctcacctatcagcacgcctagacgtcctagaacgtagtttacgaccttaacttttaattacgttcgtacaggtactaaggtccgtaagacctaacgttcggtacccttcgttaccgttaccgtttccggggaccgggtaacggggtaccggtaggggttcgggaacggtacgtaccggaacggtaaccggtaacggttcgggttacgggaccgttacggacccgtaacccgtacgttccgttacggttaccg

SEQ ID NO: 272859 - DNA, 536 bp, Homo sapiens
  misc_feature: GYAE6OF02HHMPV.47.76.G10.1.454.CMB.1.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctcccaggctcctcatctatgatgcatccaanacgggccactggcatcccagccaggttcagtggcagtnagtctgggacagacttcactctcaccatcagcagcctagacgcctagaagtatttgactactttattactgtcagcagcgtagctaacgtgccctctctacgtttcgggacggaacgggtaccgaggggtggaggtacgtacgaggaccgtaacgtggtacggtccgtacgccgaaccgtacttccgtagtttaccg

SEQ ID NO: 272860 - DNA, 576 bp, Homo sapiens
  misc_feature: GYAE6OF02HMAP2.47.76.G10.1.454.CMB.1.raw
  modified_base (285)..(285): a, c, t, g, unknown or other
  misc_feature (285)..(285): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggcctcccaggcctcctnatctatgatgcatccaacgagggccacgtggcactccccagccaggttcaggtggcagtgagtcgtgggacagacttcactctacaccatcagcacgcctagacgcctagaagtatttgacttacttttattacttgtactagcagtccgtagacctaacgtcggtcccttccgtaccgttaccgttttcggggaccggtaacggggtaccgaggggtacggagtacgtacgaacggaacggtaacgttggtacggacgtacggaccgtaccgtacgttccgtgttacccg

SEQ ID NO: 272861 - DNA, 491 bp, Homo sapiens
  misc_feature: GYAE6OF02HWINI.47.76.G10.1.454.CMB.1.raw
  modified_base (254)..(254): a, c, t, g, unknown or other
  misc_feature (254)..(254): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaanagaaacctggccaggctcccaggctcctcatctatgatgcatccaacaggggccactggcatcccagccaggttcagtggcagtgagtctgggacagacttcactctcaccatcagcagcctagagcctgaagtatttgctactttattactgtcagcagcgtagcaactgcctctcactttcggcggagggacgagggtggagagtcgagacgaacgtgtggctgcaccatctgtc

SEQ ID NO: 272862 - DNA, 514 bp, Homo sapiens
  misc_feature: GYAE6OF02IDHB7.47.76.G10.1.454.CMB.1.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctcccaggctcctcatctatgatgcatccaacngggccactggcatcccagccaggttcagtggcagtgagtctgggacagacttcactctcaccatcagcagcctagacgcctagaagtatttgctactttattactgtcagcagcgtagctaactcggccttctctacgtttcggcggacgggaccgagggtggagagtcgaagacgtaacgtggtaggcgtcggaccaccgattcgtgttcc

SEQ ID NO: 272863 - DNA, 520 bp, Homo sapiens
  misc_feature: GYAE6OF02I0RVB.47.76.G10.1.454.CMB.1.raw
  modified_base (195)..(195): a, c, t, g, unknown or other
  misc_feature (195)..(195): n is a, c, g, or t
  modified_base (300)..(300): a, c, t, g, unknown or other
  misc_feature (300)..(300): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggctccaggctcctcatctatgatgcatccaacngggcccacgtggcatccccagaccaggttcagtggcagtgagtctgggacagacttcactctcacatcagcagcctagacgcctagaagtatttgactactttattactgtcagtcagcgtagctaacgtggcccttctctactttcgggcggacgggaccgagggtgagtagtcgaagacgaacgttggtcggacgtcggacctaccactcgtagttcg

SEQ ID NO: 272864 - DNA, 513 bp, Homo sapiens
  misc_feature: GYAE6OF02G40IF.47.76.G10.1.454.CMB.1.raw
  modified_base (195)..(195): a, c, t, g, unknown or other
  misc_feature (195)..(195): n is a, c, g, or t
  modified_base (303)..(303): a, c, t, g, unknown or other
  misc_feature (303)..(303): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccaggcctcctcatctatgatgcatccaacngggccacgtggcatcccagccaggttcagtggcagtgagtctgggacagacttcactctcaccatcagcagcctagacgcctagaagtatttgactactttattactgtcagcagcgtagactaactcggtcctctctacgtttcggcggacgggaccgagggtggagacgtcgagacgaacgtggtggcgtcgaccacctacgtctgtc

SEQ ID NO: 272865 - DNA, 537 bp, Homo sapiens
  misc_feature: GYAE6OF02HRB3F.47.76.G10.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccaccctgtctttgtctccaggggaaanagccaccctctcctgcagggccagtcagagtgttggcagctacttagcctggtaccaanagaaacctggtcaggctcccaggctctcatctatgatgcatccaacagggccactggcatcccagacaggttcagtggcagtgagtcgtgggacagacttcactctcaccatcagcagcctagacgcctgaaacgtattttcggactactttaattactgtactagcagtcgtagctaactggacccttctctaaccgtttcgggcggtagggaccgaggggttaggagtagtcaaggtacggaacgtggtcggactcggacctacgacttccgtgttaccg

SEQ ID NO: 272866 - DNA, 543 bp, Homo sapiens
  misc_feature: GYAE6OF02HJ6Y3.47.76.G10.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (342)..(342): a, c, t, g, unknown or other
  misc_feature (342)..(342): n is a, c, g, or t
  modified_base (380)..(380): a, c, t, g, unknown or other
  misc_feature (380)..(380): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagaatattcactcctacttagcctggtaccaanagaaacctggtcaggctcccaggctcctcatctatgatgcatccaacagggccactggcatcccagacaggttcagtgcagtgggtcngggacagacttcactctacactatcagcagcctagacnctgaagtacttggactttatactgtacagtcagtcgtgtagttccgtcggcccttccggcttccgtacgtttcgggcggtagggaccgagggtggagtacgtacgaaacggtaacgtggtacggctcgaccgaccgtacgttcgtcgttcttcgacttccccg

SEQ ID NO: 272867 - DNA, 562 bp, Homo sapiens
  misc_feature: GYAE6OF02IKSRY.47.76.G10.1.454.CMB.1.raw
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctccncatctatgatgcatccaacgagggcccacgtggaccactcccagccaggttcaggtggcagtgagtcgtgggacagtacttcactctcaccatcagcagcctagacgcctagaagtntttcgacttactttattactgtcagtcagcgtagctaacgtcggccttctacgttaccgtttcgggacggtacgggaccgtaggggtaggaagtacgtacgaacggtaacggtaacgttcggtacggtctacggaccctaccgtacgttccgttacgttaccg

SEQ ID NO: 272868 - DNA, 528 bp, Homo sapiens
  misc_feature: GYAE6OF02IBC5H.47.76.G10.1.454.CMB.1.raw
  modified_base (363)..(363): a, c, t, g, unknown or other
  misc_feature (363)..(363): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagaatattcactcctacttagcctggtaccagcacaaacctggccaggctcccagacctcctcatctatggcgcatccagcagggccactggcatcccagacacgttcagtggcagtgggtctggggacaggacttcactcncaccatcagcagcctagacgcctagaagtactttggtaactttattactgtcagcagcgtgagttctggtcctccgctctcgtttcggcggaggaccgagggtcgagacgtacgaaacggactggtacggtcgtcgacctaactacgttcgtcgttcttctaccg

SEQ ID NO: 272869 - DNA, 534 bp, Homo sapiens
  misc_feature: GYAE6OF02FHQUQ.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccacgtggcatcccagccaggttcagtggcagtgggtctgggacagacttcactctcacatcagcacgcctagacgcctagaagtacgtttggtactttattacttgtcagtcaggcgtgtagttctcggcctccgctctacgtttcggcggtacgggaccgtagggtggagacgtacgaaacggtacgtggtcggctcggacaccgtagtcgtcgttccttactaccg

SEQ ID NO: 272870 - DNA, 740 bp, Homo sapiens
  misc_feature: GYAE6OF02GVQVR.47.76.G10.1.454.CMB.1.raw
tcagagctcacgtacacgaccggtgctcgatttagtcactcatactaggggtaggggaactggactcagttacggaccccagacgggaaccgatggaagccccaggctcagcttcggtcttcctccgtgacgtactcctgggcctcccagataccgatcggagagttgtgtttgactacacgttctaccagcctaccctgtacttttagtcctccagggggtaaagacgccacccgtcctccgtagacgacgggtccaaggttcgaagtaagtacgttacacctaccgtacgttagccgttgggtaccaacagtaaacccgttggtaccaaggctacccgttaggcgtcccgtcactcctatgactaggccattcccaacgaggccagttggactatcccgagtcgaggttccagtcgcgaggtcggtacgtacgggacacggacctttacacgttacttactaccgtagtccgaacggcaacgggtacccggtaagaacggcctaaggaaacgttacgttttacgggaaccctttttaggtaccgtaggttaaccctaggtacctacggttccgttacgtacgttaccgtccggttacccctacccggacgttcccgtaacgttttccgggaccggttacccgggtaccgacggggttccggacgtacgtaccgaaaacgggtaccttcggtaccggtccgtacgaccgaccgtagttccgtcggttaccttcgtaccg

SEQ ID NO: 272871 - DNA, 525 bp, Homo sapiens
  misc_feature: GYAE6OF02F5VE5.47.76.G10.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (393)..(393): a, c, t, g, unknown or other
  misc_feature (393)..(393): n is a, c, g, or t
  modified_base (430)..(430): a, c, t, g, unknown or other
  misc_feature (430)..(430): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggccaggctcccaggctcctnatctatgatgcgtccacagggccacgtggttcccagccaggttcagtggcaggtgcgtctggggacaggagtttcactctcaccatccaacacgcctgcagtctgaagtntttgctagtttatactgtcagctagtatacataacgnggccgctcaccttcggaccaaggacacgacgtaggagtattaaacgacgttggtagacgtgactaccgtctcgttctctcgacttcccgtacccg

SEQ ID NO: 272872 - DNA, 523 bp, Homo sapiens
  misc_feature: GYAE6OF02GNT79.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggtcaggctccaggctcctcatctatgatgcatccaacagggccactggcatcccagacaggttcagtggcaggtgggtctgggacagacttcactctcaccatcagcagcctagacgcctagaagtattttgctagtttattacttgtcagtctaacgtaatactcggcctccgctctacgtttcggcggtacggaccgagggtgacagtacgaaacgtaactggtcggctacgacaccgattcctgtccttcattcccg

SEQ ID NO: 272873 - DNA, 516 bp, Homo sapiens
  misc_feature: GYAE6OF02GP3A1.47.76.G10.1.454.CMB.1.raw
  modified_base (303)..(303): a, c, t, g, unknown or other
  misc_feature (303)..(303): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggcctccaggctcctcatctatgatgcatccaacgngggccactggcactccccagccaggttcagtcggcagtgagtcgtgggacagacttcactctcaccatcagcacgcctagacgcctagaagtatttgactactttattactgtacagtcagcgtagacaacgtcgcctctctaccgtttcggcggacgggaccgagggtgagtagtcgagacgtaacgtggtggctcgccacgcttcgtgttc

SEQ ID NO: 272874 - DNA, 256 bp, Homo sapiens; identical to SEQ ID NO: 272721
  misc_feature: GYAE6OF02H5W8A.47.76.G10.1.454.CMB.1.raw
  modified_base (252)..(256): a, c, t, g, unknown or other
  misc_feature (252)..(256): n is a, c, g, or t

SEQ ID NO: 272875 - DNA, 520 bp, Homo sapiens
  misc_feature: GYAE6OF02HFC3F.47.76.G10.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
  modified_base (345)..(345): a, c, t, g, unknown or other
  misc_feature (345)..(345): n is a, c, g, or t
  modified_base (428)..(428): a, c, t, g, unknown or other
  misc_feature (428)..(428): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgctccaggggaangccaccctntcctgcagggccagtcagagtgtggcagctacttagcctggtaccaanagaaacctggccaggctcccaggctcctcatctatgatgcatccaacagggccagtggcatcccagccaggttcagtggcagtgagtctgggacngacttcactctcaccatcagcagcctagcgtcctagaagtatttgactactttattactgtacagcagctagcaacgtgcctntctacgttcgggacggagggaccgaggggtagagtacgtacgaaggacggaacgttggtcggacttcggaccacgtagttccgtacgttccg

SEQ ID NO: 272876 - DNA, 564 bp, Homo sapiens
  misc_feature: GYAE6OF02I6UXM.47.76.G10.1.454.CMB.1.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctcccaggcctcctcatctatgatgaccatccaanagggccacgtggcactcccagccaggttcagtggcagtgagtctgggacaggacttcactctacacctatcancacgctaagngcctagtaacgtatttgactactttaattactcgtactagacagtacgtagactaacgtcggtcccttctaccgttaccgtttacgggcggtacggggaccgtaaggggtcggaaggtagtacggaacgacgggtaactggtacgggctcggtaccaactacgttcgtcgttacccg

SEQ ID NO: 272877 - DNA, 536 bp, Homo sapiens
  misc_feature: GYAE6OF02IS46J.47.76.G10.1.454.CMB.1.raw
  modified_base (291)..(291): a, c, t, g, unknown or other
  misc_feature (291)..(291): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagagttccaccggagacattgttttgacacagtctccagccaccctgtctttgtctccaggggaaagagccaccctctcctgcagggccagtcagagtgttggcagctacttagcctggtaccaacagaaacctggaccaggctcccaggctcctcatctangatgcatccaacagggccactggcactcccagccaggttcagtggcagtgacgtcgtgggacagacttcactctacacctatcagcacgacctaagacgtcctagaaagtatttggacttactttaattacgtgttacagtcgagcgtagactaacgtcgtcctctcgtacgtttcgggacggacgggacgaggggtgaagacgtcgacgacgaacgtggtacggcgagccacacttcgtgttac

SEQ ID NO: 272878 - DNA, 504 bp, Homo sapiens
  misc_feature: GYAE6OF02GQ0E6.47.76.G10.1.454.CMB.1.raw
  modified_base (301)..(301): a, c, t, g, unknown or other
  misc_feature (301)..(301): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaanagggccactggcatcccagccaggttcagtggcagtgagtctgggacagacttcactctcaccatcagcagcctagacgcctgaagtatttgctactttattactgtcagcagcgtagcaactgcctctctacgttcggcggacgggaccgagggtggagacgtcgaagtacggaactggtggtctggccacgactcctgtac

SEQ ID NO: 272879 - DNA, 519 bp, Homo sapiens
  misc_feature: GYAE6OF02FNMX4.47.76.G10.1.454.CMB.1.raw
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggcctccaggctcctcatctatgatgcatccaacagggccactggcactcccagccaggttcagtggcaggtnagtctgggacngacttcactctcaccatcacgcagcctagacgcctagaagtatttagctactttattactgtcagcacgtcgtagcaacgtcgtcctctctacgttcggacggtagggaccgagggtggagtagtcgagaaccgagtacggtggcgtacgcgacctctacgtgttacc

SEQ ID NO: 272880 - DNA, 730 bp, Homo sapiens
  misc_feature: GYAE6OF02H6T1J.47.76.G10.1.454.CMB.1.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccaccctgtctttgtctccaggggaangccaccctctcctgcaggccagtcagagtattagcagcaattagcctggaccagcagaaacctgggcaggctccgaggctccncatctatggtnctatccgaaccgaggtccacgtcggacactcccagtaaccagggttcagtggactaggttgggtcgtaggggactaacggtacttacgtacctctaccgaacctatcgaacgcctagacccgtaagacgtccgtaagaaacgttacgtttacgggtaaccttttaagttacttacgtccgttaaggtacgtacggttacggttacgtaacgggttttccgttaccgggttaccccttcccggtaccctttaccggtttacccgggttttaccggggccggggtaaacgggtaaccccggttaggggggttaccgaacgggtaaccgtttaacccggaaaaaccggttaaccggttagggtaaccggggttaccttaaccgggacccttaacccggtacgttttacccgttaacggttttaccgttacccgtttaaacccgg

SEQ ID NO: 272881 - DNA, 597 bp, Homo sapiens
  misc_feature: GYAE6OF02HVB1P.47.76.G10.1.454.CMB.1.raw
  modified_base (377)..(377): a, c, t, g, unknown or other
  misc_feature (377)..(377): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagaatattcactctacttagctgtacacagaactggtcaggctccaggctcctcatctatgatgcgtccaccgacgggccacgtcggtttccccagtcccgtaggttcaggttggctaggtgcgtcgtgggacagagttcactctacacatcaacncgcctgactagtctagaacgttatttcgacttactttattcgtgtcagtcagtcgtagactaacgtcggtacctctaccgtacgttccgggcggtacgggaccgtaggggtacggaacgtacgtaccgaggtaaccgtaacggttcggtacggtacgtacgtaccgtaaccgttacgttccgttcggttaccctttacgttaccgtacccgttaccccgg

SEQ ID NO: 272882 - DNA, 490 bp, Homo sapiens
  misc_feature: GYAE6OF02HCHKY.47.76.G10.1.454.CMB.1.raw
  modified_base (303)..(303): a, c, t, g, unknown or other
  misc_feature (303)..(303): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacngggccactggcatcccagccaggttcagtgcagtgagtctgggacngacttnactctcaccatcagcagcctagagcctgaagtatttgctactttattaactgtacagcagcgtagcaactggcctctcactttcggcggagggaccgagggtcggagagcagacgaactgngcngcacatctgtc

SEQ ID NO: 272883 - DNA, 707 bp, Homo sapiens
  misc_feature: GYAE6OF02IXLT3.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtcttgtctccgaggggaaangccaccctctcctgcagggccagtcagaatatcactcctacttagcctaggtaaccaacagaaacctggtacacggtcctccaggtcctcctccattctaagtgactcgacactccaaacgagggccacgtggacactcccgagacgtacggttcagtcggcaggtcgggtactcgggactacgtaacttcacgtcacgaccgatacgagcacgaccgtagactcccgtaggaacgttacgtttaggtaaccttttagtaccttggtacgtaacgcgtacggtcggttaacgtacgtttccgttacgggcccttaccgggccttaccgttacccgggttttccgggaccggggtaaacgggttacccggtagggggtaacggtacggtaacgttaacccggtaaaaccgggtacgggttaacgggttacggggaacccgttacggtaaccccgtaacccgttggtttaccggttaccggtttaaccggtttaccgtaccgttttacccccgg

SEQ ID NO: 272884 - DNA, 543 bp, Homo sapiens
  misc_feature: GYAE6OF02FYDU5.47.76.G10.1.454.CMB.1.raw
  modified_base (195)..(195): a, c, t, g, unknown or other
  misc_feature (195)..(195): n is a, c, g, or t
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctcccaggcctcctcatcgtgggatgcatccaaacgngggccgctggcatccccagccaggttcaggtggcaggtgggtctgggacagtacttcactcncaccatcagcagcctagagcctgaagtatttgctagtttattactgtcagactaaacgtaaatacgtcggtcctccgcttctacgtttcgggcggacgggaccgagggtcggactagtacgaacgacgtggtcggcgtcgaccacgtagtctgtccttctacttcctcccgtacc

SEQ ID NO: 272885 - DNA, 509 bp, Homo sapiens
  misc_feature: GYAE6OF02IFJT8.47.76.G10.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (484)..(484): a, c, t, g, unknown or other
  misc_feature (484)..(484): n is a, c, g, or t
  modified_base (503)..(503): a, c, t, g, unknown or other
  misc_feature (503)..(503): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctcccaggctcctnatctatgatgcatccaacngggccactggcatcccngccaggttcagtggcagtgagtcgtggactaggacttcgactctcaccatcagcagcctagacgctagtaagtatttgctactttattactgtcagcagccgtagccaacgtcgcctctctacttcggcggaacggacgtgggtaggagtatcgagacgacgtgnggcgtcgactaccagttcngttccg

SEQ ID NO: 272886 - DNA, 627 bp, Homo sapiens
  misc_feature: GYAE6OF02I6DIT.47.76.G10.1.454.CMB.1.raw
  modified_base (198)..(198): a, c, t, g, unknown or other
  misc_feature (198)..(198): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacatttgttttgacacagtctccagccaccctgttctttgcctccgaggggaaancgccaccctctcctgcgagggccagtcagagtgttggcagctacgttagcctaggtaaccaacacgaaacctggacccagggcctacccgaggcctcctacatctatgactgacactccaacgacggcccaagtcggacaactcccgagccgtaggttcaaggtgacaggtcgaggtcgtaggggaccaggtaccttacgacctttacacctacctacgtcgaacgtcgaacgtcctaaagccgtacctaggaaacgtttactttcgacttaacttttacgtaccgtgtacacgtctaacgtcggtaacgccgtaacgttcgtccttaaccgtcgttacggttcggacggtacgggaccgtggggtacgagtacgtcggaaggtacgaaccgttggtcggcgtaccgcctaccgtacgtcttagttacc

SEQ ID NO: 272887 - DNA, 605 bp, Homo sapiens
  misc_feature: GYAE6OF02JVEEW.47.76.G10.1.454.CMB.1.raw
  modified_base (197)..(197): a, c, t, g, unknown or other
  misc_feature (197)..(197): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
tcagagctcacgtacacgaccggtgctcgatttagtcactcatacaggggaggaactgctcagttaggacccagacggaaccatggaagccccagcgcagcttctcttcctcctgctactctggcctcccagacgaccactggaagaaatagtgatgacgcagtctccagccacctgtctgtctctccgaagggaancgcccacctctcctgcgacgggccagtcaagtatactccactacctattacgcctacggtaaccaacgacgtaaaccgtggtacacggtccctaccgacggtccttcctacacttcctatagacttcgactactaccgaacgacggccacgtcggactacgtccgagactaggttcaggtcgacagtgacgtcgaggacagtctcacgtctcacntcncgacagcctagcncgtagtaattctttacgtactttactcgtgtacgagtactaggtacgtacgactacgtcgtacttaccttcgttaaccggttccgggacgggtaacggaccggtagggtacgtaacggtacgtaacggaacggtacgtcggtacggtactacggaccgtactcgttactcggttacc

SEQ ID NO: 272888 - DNA, 633 bp, Homo sapiens
  misc_feature: GYAE6OF02GM2ZO.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgtggcagctacttagcctggtaccaacagaaacctggaccaggcctccaggcctcctcatctatgatgcatccaaacgcgggccacgtggcactcccagccctaggttcaggtggctaaggtgacgtcgtaggggactacgtaccttcacttcctaccacctataccgagaccaacgcccttaagacgtccgtagtaaacgttacgttttcgacttaacttttaactttaacgtcgttacaacggtctacggtacggttagaccgtaacggttcgtcccttcgttacccgtacgtttccgggacgggtaacggggtaccgaggggtacggaaggtacgtacggaacgggtaaccgaacggttcggtagggtcctacggacccgtaaccgtacgttcgtcgtttaccg

SEQ ID NO: 272889 - DNA, 601 bp, Homo sapiens
  misc_feature: GYAE6OF02I4A8T.47.76.G10.1.454.CMB.1.raw
  modified_base (195)..(195): a, c, t, g, unknown or other
  misc_feature (195)..(195): n is a, c, g, or t
  modified_base (303)..(303): a, c, t, g, unknown or other
  misc_feature (303)..(303): n is a, c, g, or t
  modified_base (353)..(353): a, c, t, g, unknown or other
  misc_feature (353)..(353): n is a, c, g, or t
  modified_base (393)..(393): a, c, t, g, unknown or other
  misc_feature (393)..(393): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccactggagaagttattttgacacagtctccagccaccctgtctttgtctccaggggaaangccaccctctcctgcagggtcagtcagagtgttgacagctacttagtctggtaccaagagaaacctggccaggctcccaggcctcctcatctgggatgcatccaacgngggccgctggcactcccagcctaggttcagtggcaggtgggtctgggacngtacttcactctcacatcagcagcctagacgcctgaagtnttttagcttagtttacttactgttacacgtactaaacgttaaattaccgtcggtcctccgtcttaccgtaccgtttcgggacgggtacgggaccgtaggggttacgacgtagtacggaaaccggtaacgtgggtacggtaccgttaggacccgtaaccgtacgttaccgttcggttaccctttacgtaccgtttccccgttacccccg

SEQ ID NO: 272890 - DNA, 554 bp, Homo sapiens
  misc_feature: GYAE6OF02F2JYR.47.76.G10.1.454.CMB.1.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcagggccagtcagagtgtggcagctacttagcctggtaccaacagaaacctggccaggctccaggctcctnatctatgatgcatccgaacgnggccacgtggcactcccagcctaggttcaggtgcagtgagtcgtgggacagtacttcactctacacatcagcacgcctagacgtccgtagtaagtatttcgacttactttacttacgtgtacacgcgtacgtacgtacgacgtaacgtcggtccttcgttactaccgtttcggacgggtacgggaccgagggtaggacgacgtacgaacggtacgtaacgtgtacggtctacgaccgacgacttcgtgttcc

SEQ ID NO: 272891 - DNA, 634 bp, Homo sapiens
  misc_feature: GYAE6OF02HQU64.47.76.G10.1.454.CMB.1.raw
  modified_base (193)..(193): a, c, t, g, unknown or other
  misc_feature (193)..(193): n is a, c, g, or t
  modified_base (250)..(250): a, c, t, g, unknown or other
  misc_feature (250)..(250): n is a, c, g, or t
  modified_base (298)..(298): a, c, t, g, unknown or other
  misc_feature (298)..(298): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagccaccctgtctttgtctcaggggaangccacctctcctgcagggccagtcagaatattcactcctacttagcctggtaccaanagaaacctggtcaggcctccaggctcctcatctatgatgcatccaagngggccagtggcactcccagacaggttcaggtcgcgagggttgggtctggggacacggtactttcgaccttctcaacccatacgagtccagacccgtaagacgtccgtagtaacgtacgtttacggtaacttttattacttgttacacgctacggtcgtagtagttcgtcggtcccttccgtcttaccgtccgttttccggggccgggtaacgggacccgaggggttcggacggtacgttaaccggtaaaaccgggtaaccgttacggggtacgggtacccgttaccggtacccgtacccgtacgttcccgtttacggttcccgtttaccctacccg

SEQ ID NO: 272892 - DNA, 548 bp, Homo sapiens
  misc_feature: GYAE6OF02GL1WO.47.76.G10.1.454.CMB.1.raw
  modified_base (195)..(195): a, c, t, g, unknown or other
  misc_feature (195)..(195): n is a, c, g, or t
  modified_base (369)..(369): a, c, t, g, unknown or other
  misc_feature (369)..(369): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccaggcctcctcatctatgatgcatccaacgacggccatggcatcccagcctaggtcagtggcaggtgagtctgggacagtacttcactctacaccntcagcacgcctagacgtctagaacgtactttggacttttagttactgtctagcagtcgtgtacgttcgtggtccctcgcttaccgtacgtttcgggcggacgggaccgtagggtaggacgtacgtacggaaacgtacgtcggtacgcgttggcctaaccgtagtcttacggtcttaccg

SEQ ID NO: 272893 - DNA, 589 bp, Homo sapiens
  misc_feature: GYAE6OF02FNZDH.47.76.G10.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggcctccgagctcctnatctatgatgacactaccaacgacggccacgtcgcactcccgacgccgtacggttacacggtcggacgtaggtgacgtcgtagggacagtccttacgacttctacaccactacgagacctacgaccgtagaccgtccgtaagaacgtttctttgaccttacttttacttactgtacagtcacggtacgtacgtacctaacgtccgaccttctaccgttaccgttcgggacggtaacgggaccggtagggtgagtacgtcgaacggacgtaagtcggacggtcttcgaccgtactcgtcgtcgttcc

SEQ ID NO: 272894 - DNA, 561 bp, Homo sapiens
  misc_feature: GYAE6OF02I9DWX.47.76.G10.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggacaggctccaggctcctcatctatgatgcatccaacgngggccagtggcatcccagccaggttcagtgcagtgagtcgtgggacagtacttcactctaccacatcagcacgctagacgcctagaagtactttgactactttattacttgtacagtctaggcgtacgactaacgtcggccttactcctacgtttccgggacggtacggggaccgtaggggtcgaggtacgtacggaacggtacggtaacgtcgggtacggtcgtacggaccctaaccgtacgttccgtaggtttaccc

SEQ ID NO: 272895 - DNA, 693 bp, Homo sapiens
  misc_feature: GYAE6OF02HYK6A.47.76.G10.1.454.CMB.1.raw
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (569)..(569): a, c, t, g, unknown or other
  misc_feature (569)..(569): n is a, c, g, or t
tcagagctcacgtacacgaccggtgctcgatttagtcactcatacaggggaggaactgctcagttaggacccagagggaaccatggaagccccagctcagcttctcttcctctgctactctcggctcccagattccaccggagacattgttttgacacagtctccagccaccctgtctttgtctccaggggaaanagccaccctctctcgcgacggcacgtacgaggngttggtcgacgacgtaccttacgtacncgttacgaaccaacgtaaacgtaaccgtcggacgacggtcctaccggacgtccttcctatacttactagtacgtagtaccgactacctaaccgaacgggaccggaccctacggtcgacctaccctaccgacgaccggttagtacgacggtcgacgtagtcggtacgttacgggacggaacgaacgttcgtacctacttaccacctaactctacgacgtacgccgtaaccgacgtaccgtcgtaaagttaaacgtttgttaccgtaacttttaactttacttacgttacgtacgtacgacgtacggtaacgttanacccgtagtcccgtaccttctaccgttacggtccggggtaggaccgggtaccggtaggtacgaagttccaacggacgtaacgcggttacgcgtacgacggacctacgtcgttcgtaccgttacg

SEQ ID NO: 272896 - DNA, 556 bp, Homo sapiens
  misc_feature: GYAE6OF02G2MNA.47.76.G10.1.454.CMB.1.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggcctcccgaggctccncatctatgatgcatccaacagggccacgtggcatcccagccaggttcagtgcaggtgagtcgngggacaggaccttgacctctaccaccatccagcagccctagacncctgaatntttgactatttntactgtcanctagccgtagacctaacgtcggcccttcgtaccgtacgtttccgggacgggaacgggtacctaggggtcggacgtagtccgaaggtaccggtaacgttggtagggaccttcgggccctaacgcttccgtgttaccc

SEQ ID NO: 272897 - DNA, 511 bp, Homo sapiens
  misc_feature: GYAE6OF02HRII1.47.76.G10.1.454.CMB.1.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (377)..(377): a, c, t, g, unknown or other
  misc_feature (377)..(377): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagaatattcactcctactagcctggtaccaacagaaacctgggacaggctcccaggctcctcatctatggtncatccaacagggccacgtggcactcccagccaggttcaggtggcaggtgcgtcgtgggacagtagttcactctcaccatccaancgcctgactagtctagaagtatttgacttaatttattactgtcagactagtataatacgtgtcctcgctcgacaaggacacgatagatagtaacgactaggtgactgacacatctgtctactacttcctcctac

SEQ ID NO: 272898 - DNA, 580 bp, Homo sapiens
  misc_feature: GYAE6OF02HFQQB.47.76.G10.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (283)..(283): a, c, t, g, unknown or other
  misc_feature (283)..(283): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagccaccctgtctttgtctccgaggggaangccaccctctcctgcagggccagtcagaatattcactcctacttagcctggaccaanagaaacctggtcaggcctccgaggcctcctnatctatgatgcactaccaacgacgggccacgtggcactcccaggtacctaggttcaggtggactagggtgggtcgtagggacagtaccttcactctacaccgatcgacgcacgcctagcgcgtagaacgtacgtttaggacttttatacgtgtacagtctagtcgtagtcgttcgtcggtccctccgtctccgttacgttccgggacggtacggaccggtagggtacggagtaacgtaccggaaaacggtcgttggtacggtcgtagaccgtactagttccgtgttaccttcgtacc

SEQ ID NO: 272899 - DNA, 565 bp, Homo sapiens
  misc_feature: GYAE6OF02IFQUK.47.76.G10.1.454.CMB.1.raw
  modified_base (194)..(194): a, c, t, g, unknown or other
  misc_feature (194)..(194): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaanagccaccctctcctgcagggccagtcagagtgttggcagctactagcctggtaccaacagaacctggccaggctcccgaggcctcctcatctatgatcgacatccaacgcgggccacgtggcactcccagcctaggttcaggtggacaggtgagtcgtagggactagacttcactcacaccatcagcacgcctagacgtcctaggtaagtagtttcgacttaagttttaacttactgtactagactagtatactaagttaacgtcggtaccgtctaccgtaccgttccggaccgaaagggaccacgtacgtaggaacgtaacgttaaacggacgtcggtacgcgtacgacctacctatcgttcgtcttacg

SEQ ID NO: 272900 - DNA, 633 bp, Homo sapiens
  misc_feature: GYAE6OF02HL4V3.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccgaggcctcctcatctatgatgacatacccaaacgacgggcccaacgtcggccaacgtccccaggtccctaggttcaggtggacctaggtgaggtcgtaggggaactaggtaccttcaccgttctaccaaccctatccgaagccaacgtaccgtaaggacgccgtagtaaagttacttttcgacttaacttttattaccttgtactagtcagtacggtacgcgtaacgtcggtcccttcgtaccgttacgtttccgggacgggtaacgggtaccgtaggggtacggaggtacgtaccgaacggtacggtaacgtgggtacggtcgttacggacctaaccgtacgttccgttacgttaccg

SEQ ID NO: 272901 - DNA, 656 bp, Homo sapiens
  misc_feature: GYAE6OF02GISPE.47.76.G10.1.454.CMB.1.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
tcagagctcacgtacacgaccggtgctcgatttagtcactcatacagggggaggaactgcctcagttaggacccagagggaaccatggaagccccagctcagcttctcttcctcctgctactctggctcccagattccaccggagactatttgttttgacacagtctccagccaccctgtctttgtctccgaggggaaagngccaccctctcctgcgagggccagtcagagtgttggcagctacttagcctggtaccaacagaaacctggaccaggcctccgaggcctctcatctatgatggcgtccacgtggcctagtcggttaccagcctaggttcagtggctaggtcgcgtcgtgggacnggtacgttcactctcaactataccaacncgtccctgacctagttccgtaagtaaacgtttgttttacgacgtttaaggtttaacttacgtcgttacgaaggtacctaagttaacgtactaaacgttaaccgttcgggtaccctacgttccctaaccgtttccgggaacccgtaaaggggtacccaaacggttacgtagggaacgtaaccgttaaacggtacggttggtacggtaccgtcgtacccgtaacttcgttacttaccggttacctttcgtaccgttcccttaccccg

SEQ ID NO: 272902 - DNA, 538 bp, Homo sapiens
  misc_feature: GYAE6OF02FVS87.47.76.G10.1.454.CMB.1.raw
  modified_base (301)..(301): a, c, t, g, unknown or other
  misc_feature (301)..(301): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctccaggcctcctcatctatgatgcatccaangggccagtggcatcccagccaggttcagtcggcaggtgagtcgtagggacaggacttcactctccacctatcagcacgcctagacgcctagaactatttcgctactttattactgtacagtcagtcgtagcaacgtcggccttctctacgtttcggcggtacgggaccgtaggggtcgaacgtcgtacgacgtaaccggtaacgtgtcggtctcggaccacgtactcgttgttaccg

SEQ ID NO: 272903 - DNA, 796 bp, Homo sapiens
  misc_feature: GYAE6OF02IUJGN.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttattttgacacagtctccagccaccctgtctttgtctccaggggaaangccaccctctcctgcagggtcagtcagagttgttgacagctacttagtctggtaccaagagaaacctggaccaggcctacccgaggcctcctcatcgtgggatgcactaccaacgcgggccctcgtcgggacctacgtccccaggtcccgaagggtttccgaggtcggcgtaggttcggggtctacggggacctaacgggttaccctttccgaaccgtttccgtaccctaaacccgtagttcccgaaagggccctaaacggtaccccgttaacggaccggtaccttagggtaaaacgtttcgtttttacgggaccttttaaggtttttaacttttaccgttggttaaccgtaacggttaacctaaaaccggtttaaagttacccgtacgggttacccttcccggttacctttaccgtacccggtttttaccgggggaccgggtaacggggtaacccggtaacgggggtacgaaaccgttaacggttaaccggtaaaccggttaacggttacggtacggggtacgttaaccgtacccgtaaccgttacgtttaccggttaccgtttaccctttaccgttacccgttaccccgtttaccccgg

SEQ ID NO: 272904 - DNA, 643 bp, Homo sapiens
  misc_feature: GYAE6OF02JMS63.47.76.G10.1.454.CMB.1.raw
  modified_base (194)..(194): a, c, t, g, unknown or other
  misc_feature (194)..(194): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagagttgtgttgacacagtctccagccacctgttctttgctccgaaggggaanacgccctacctctcctgcagggccagtcagaattactcactctactgcctggaccaacagaacctggtacaggctccgagcctctcatctatagactgctactaccgaacgacgggccaacgtcggtacaacctccccgaagtaccgtacgggtttaccagggttcggaccgtaagggtcggggtttacgacggggttaacacggtacttccgactaccgtacacctagtcacgcgtaacgaccgtagcgtctacggtaagtttactcggttattaaccggttatttacgacgttacgacgtacgtaaacgtaatccggtcgtaccgtcgtactcgtacggttcggacggtacgggccgtaaggggtacactagtaacgggtaacaacggttggacggtacgacgtaaccggaccttacggtcgtttacgactttgaccccgtttaccc

SEQ ID NO: 272905 - DNA, 536 bp, Homo sapiens
  misc_feature: GYAE6OF02IL0VS.47.76.G10.1.454.CMB.1.raw
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
  modified_base (440)..(440): a, c, t, g, unknown or other
  misc_feature (440)..(440): n is a, c, g, or t
  modified_base (533)..(533): a, c, t, g, unknown or other
  misc_feature (533)..(533): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccgaggggaaancgccaccctctcctgcacgggccagtcagagtgttggcagctacttagcctggtaccaacagaacctggaccacggcctcccgaggcctcctcactctatgatgactactaccaacgnggccacgtggcactcccgagcctaggttcaggtgcagtgagtcgtagggactagcttcactctacacntcacgcacgactagacgccgtagaagttatttcgacttactttattactgtacagtnagacgtagacacgtcgcctctcgtcgttcgggcggacgggacgagggacgagtcgacgaggacgtaacgtggtagcgtacgccagtactcgtntcg

SEQ ID NO: 272906 - DNA, 710 bp, Homo sapiens
  misc_feature: GYAE6OF02HL61B.47.76.G10.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcacgggccagtcagagtgttggcagctacttagcctggtaccaanagaaacctggccaggctccgaggctccgtcatctatgactgcatccaacgacgggtccaactcgggacacgtccccagcccgtaggttccaaggtcggccaagggttcgaacggttccgtagggggaccaacggtaaccttttccgaacctttccttaccgaaccctagttccgaacgccgtaacggacccttaacgggaccgtacccgttaggaaacggttacgttttacgtaccgttaactttttaacgttaaccgtttacggttaccgtacggtcctaacggtcggttaacggtaccgttaaacgttccgggtaccttacccgttaccgttaccggttttaccggggacggtaacggggtacccgtaggggtaccggaggtaccgttaacgacggtaacggaaccgttggtacgggtactacggacctaaccgtcgttaccgttgttacccg

SEQ ID NO: 272907 - DNA, 646 bp, Homo sapiens
  misc_feature: GYAE6OF02HT2I4.47.76.G10.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (325)..(325): a, c, t, g, unknown or other
  misc_feature (325)..(325): n is a, c, g, or t
tcagagctcacgtacacgaccggtgctcgatttagtcactcatacagggggaggaactggctcagttaggacccagagggaaccatggaagccccagctcagcttctcttcctcctgctactctggctcccagattccaccggagacattgttttgacacagtctccagccaccctgtcttgctccaggggaaangccaccctctcctgcagggccagtcagacgtgtggcagctacttagcctaggtaccaanagaaacctggccagctccgaggctcctcatctatcgattgacactccgaagacgggcctacgtggcctacncccagccaggttcaggtcggcagtgacgtcgtgggacagaccttcactcacacctatcacgcacgtcctagacgtccgtagtaacgttagtttacgccttaaactttacgttaccgttagtacgagtaccgtaggtaccgtaagaccgtaaacggtccggtacccttacgtaccgttaccggttttccggggacgggtaaccggggtaccggtaacgggggttacggaacggtaccgtaccggaaccggtaaccgggtaaaccgttgggtaccggtaccgttaccggcccgtaaacccgtcgtttaccgttgtttaccccg

SEQ ID NO: 272908 - DNA, 647 bp, Homo sapiens
  misc_feature: GYAE6OF02J1O47.47.76.G10.1.454.CMB.1.raw
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtcttgtctccgaggggaaanagccacccttctcctgccgagggccagtcagtagtattagcatcaacttgcctggtaccagcagacgacctgggcaggcctccgaggcctccgtnattctatcgatcgccgtccaccgtacgggccctacgtttcgggttcccaggtccgtaggttcaggtgctaggtcgccggtcgtggggactagtacgttcaccttacgtccacctaagctaacgagtccctaggcctagtctagtaactagtttcgacttaggtttatcgttcgttacaggtcctaagttactactacgttaactcgggcctaccgttaccgacccgtttacgggacccgtaaagggacctaacggtaccgtacgggtaacgttaaccgtaaacgggttaccgtcggttacggtaccgtacggacccgtaccgtaacgttccgtttacgtaccctttaccgtaacccg

SEQ ID NO: 272909 - DNA, 632 bp, Homo sapiens
  misc_feature: GYAE6OF02HID3T.47.76.G10.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcagggccagtcagagtgttggcagctacttagcctggtaccaacagaaacctggccaggcctcccaggcctcctnatctatgatgcatccaacgagggccacgtggcactccccagccgaaggttcaggtggacaggtgagtcgtgggaactaggtaccttcaaccttctaccgaaccctatccgaacgaccacggtaccctaaggaccgtacctacggaaagtttacgtttacgaccgtttaactttagttaaccgtttggtacctaacggcgtaacggccgttaagaccgtaacgtcggtaccctttccgttaccgttacggtttccggggcgggtaacgggtacccgtagggggtagacggtacgtcgaacggtacgtaacgttggtaggtctcggacctaccgtacttcgtgttaccg

SEQ ID NO: 272910 - DNA, 577 bp, Homo sapiens
  misc_feature: GYAE6OF02GT7NY.47.76.G10.1.454.CMB.1.raw
  modified_base (196)..(196): a, c, t, g, unknown or other
  misc_feature (196)..(196): n is a, c, g, or t
  modified_base (355)..(355): a, c, t, g, unknown or other
  misc_feature (355)..(355): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtcctttgtctccaggggaaangccaccctctcctgcagggccagtcagagtgttggcagctacttagcctggtaccaacagaaacctggccaggcctcccaggctcctcatctatgatgcataccaacagggccacgttcggcactccccagcctaggttccagtggacaggtgagtcgngggacagtactcgactctacacatcagcagccagacgcctagaagtactttcgactactttattacttgtcagctagcgtacgctaaccgtcggtacccttcttccgtacgtttccgggacggtaacggggtaccgtaaggggtcgggaggtacgtcggaacggtaacggtaccggttaggttcggaccgtcggtacccaaccgtacgttccgtgttacccg

SEQ ID NO: 272911 - DNA, 728 bp, Homo sapiens
  misc_feature: GYAE6OF02IFSNJ.47.76.G10.1.454.CMB.1.raw
  modified_base (255)..(255): a, c, t, g, unknown or other
  misc_feature (255)..(255): n is a, c, g, or t
  modified_base (422)..(422): a, c, t, g, unknown or other
  misc_feature (422)..(422): n is a, c, g, or t
tcagagctcacgtacacgaccggtgctcgatttagtcactcatacagggggaggaactgctcagttaggacccagagggaaccatggaagccccagctcagcttctcttcctctgctactctggctcccagattccaccggagactattgttttgacacagtctccagccacctgttctttgtctccgaggggaaagcgccaccctctctgcagggccagtcagagtgttggcagctacttagcctggtaccaanagaacctggccaggcctccgaggcctcctcatctatgatgacatcccaaagcgggccaacgtggctacgtcccagtcccgtaaggttcgaggtcggacgtaggttagacggtccggtggggaaccaggtaccttccgtaacttcctacaacctagtacgacgtaccncggtaaccctagggaccgtaccgtaaggtaaaggtttacttttacggtaacctttactttttaacgttaaccgttcggttaacacggttaccgtaaggtaccggtttaaacgacctaaaccggttcggcccctttaacgttcccgttaaccgggtttaccggggacggggttaaccgggtaaccgggagggggtttacgaacggtaaccgttacgggaaaccggtaaccggtaaacgggttcgtaccggggttacccgaaggtacccccgttaaaccggtcgtttacccggtacggttttaacccc

SEQ ID NO: 272912 - DNA, 744 bp, Homo sapiens
  misc_feature: GYAE6OF02GUCM3.47.76.G10.1.454.CMB.1.raw
  modified_base (194)..(194): a, c, t, g, unknown or other
  misc_feature (194)..(194): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaangccaccctctcctgccagggccagtcagagtgttggcagctacttagcctggtaccaacagaaacctggccaggctcccaggcctcctcatctatgatgacactccaacgagggtcccaacgtgggcactcccaaggccctaagggttccaaggttcggctaacgggtgacggtcgtcggggaactggtaacctttcgaacttcctaccaaccagttccaacggcctaacggccccgttaaagggaccgtacccggttaaggtaaaggttaccttttaggaccctttaaaccgtttttaaacttacccggttaggttacccaagggtacccgtaaggtacccgggttaaggtaaccccgttaaaccgggttccgggtacccctttaacggttaccccggtttaaccggggttttacccggggaccgggtaaccgggggtaaccccgtagggggggtttacgaaccgtacggtcggtaaaccggtaaccgggtaacgttcgggtaacggtcggttccgaccggtacccttaaggttcccgagttttacccc

SEQ ID NO: 272913 - DNA, 675 bp, Homo sapiens
  misc_feature: GYAE6OF02HEPDK.47.76.G10.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (387)..(387): a, c, t, g, unknown or other
  misc_feature (387)..(387): n is a, c, g, or t
tcagagctcacgtacacgaccggtgctcgatttagtcactcatacaggggaggaactgcctcacgttagggaccctagagggaacctatggtaagccccagctcagcttctcttcctcctgctactctggcttcccgagtattccaccggagactattgttttgactactagtctccagccacctgtcttgctcagggaangccacccgtntcctgcaggccaggtcagagtgttgcagctacttagcctggtaccanagaacctggaccaggtctcccgagctcncatctatgatcgcagtccgaacngggccagtgcactccagtcctaggttcaggtgctagtcgagtctacgggacaggtacttcgacctcgtacgacctaancacgcacgacctagacgtaccctagaaacgtactttacgacttaactttacttaacgttactacgtaacgtacaacggtaccgtacgaccgtaaccggttccgggacccttaccggtacccgtttaaccggttttaccgggacccgggtaaacgggttacccgtacggggggttacgacgggttacgtaacggtaaccgggtaaaccgggtaaacgttcgggttaccgggtaccgttacgggtaaacccgttacccggttaacgtttacccgttaccgtttaacccgg

SEQ ID NO: 272914 - DNA, 536 bp, Homo sapiens
  misc_feature: GYAE6OF02FNGA7.47.76.G10.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggcccaggcctcccaggctcctcatctatgatgcatccaacgnggccacgtggacatcccagccgaggttcagtcggcaggtgagtcgtagggacagtactcactctcaccatcagcacgtccagacgcctgaagtatttcgctactttacttactgtcacgcagtcgtacgactacgtcgtccttcgtactacgtttccgggcggtacgggaccgtaggggtacgacgtagtcgaaggacgaacgtggtggctcggccacgtactctgttacc

SEQ ID NO: 272915 - DNA, 537 bp, Homo sapiens
  misc_feature: GYAE6OF02F0RHC.47.76.G10.1.454.CMB.1.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
  modified_base (399)..(399): a, c, t, g, unknown or other
  misc_feature (399)..(399): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccgaggcctcctcatctatgatgcatccaagnggcccatggcactcccagccaggttcagtggcagtcgagtcctagggacaggacttcactcgtcgcctatcagcagcctagacgcctagaagttntttcgactactttattactgttcagcagtcgtagtacaacgttcggcctcgtcttacgttcggcggacggaccgtgggtgagacgtcgaacgacgtacgtggttcggcgttcggacctaccgacttccgttgttaccg

SEQ ID NO: 272916 - DNA, 639 bp, Homo sapiens
  misc_feature: GYAE6OF02GRHRZ.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccacctgtctttgtctccaggggaagagccaccctctcctgcagggtcagtcagagtgttgacagctacttagtcgtgtaccaagacgaaacctggaccaggcctacccgaggcctccctcgatccgtggggtaactcggaccactacccaaacggacggggcccgcgtagggaccactccccgagcccgtagggttccaaggtcgggactagggttcggggtctggggacaggtaccttcaacctctaccacctataccacgcacgcctaaggacgtcctaggaaacgttatttgacttagttttactactggtacagtaacgtaaacgtaacttacgtcggtcctccggtacttaccgtacgttcgggacggtacggtacgaggtacggacctagtaggaaccgtaaggtcggtacggtcgtacggaccaccgtacgttcgttcgtaccttacgtacgtccccgttcccg

SEQ ID NO: 272917 - DNA, 600 bp, Homo sapiens
  misc_feature: GYAE6OF02HIQKR.47.76.G10.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggtcagtcagagtgttgacagctacttagcctggtaccaanagaacctggccaggctccaggctcctcatctatgatcgcatcccaacacgggccacgtggaccactcccagcctaggttcaggtggacaggtgagtcgtgggacagtactcactctacaccatcacgcacgctagacgctagaagttatttgacttactttaattacgtgtacacgtacagtacgtagaccgtaacgtcggtcccttcgtccgttaccggtttccgggacgggtaacgggacccgtaggggtacggtaacggtacgtacgtaacgggtaaccggtaacggttcggtacgggcgtttaccggacccgtaacccgtacgtttccgttacgtttacccg

SEQ ID NO: 272918 - DNA, 720 bp, Homo sapiens
  misc_feature: GYAE6OF02I7PBU.47.76.G10.1.454.CMB.1.raw
  modified_base (218)..(218): a, c, t, g, unknown or other
  misc_feature (218)..(218): n is a, c, g, or t
tcagagctcacgtacacgaccggtgctcgatttagtcactcatacaggggaggaactgctcagttaggacccagagggaaccatggaacgccccagctcagcttctcttcctcctgctactctcggcctcccagtacttccgaccggagacagttgttttacgacactacgtctccacgccctacccttgttcctttcgtccgtccgaaggggaaacncgcccacccttctccgtgcgacggccagtcagagtgtacgcagtctactacgcctacgtaccaacacgaacctggaccaggcctccgaggtcctcctactatcgtacggtactacgctaactaccgaacggccgggtcccgcgtacgggcctaaccgtacccgacggtaccgtacggttcgaacggtcggtaccgtacgggttaccgggtcgtacgggtaactacggttaaccgttacctaccgttacctaccgtaccgtactacggacgtacctacggtacctaacggcgtaaccgtaggtaacgtttaccgttacggttaacctttacgtacgtacgtttcacggtctaacggtcgtagtccgtcgtcgcccgttctcctacgtacggtccgggacgggtaccggtacgtacgggtacgcgttacgacggtaacggtggttcggacgtgaacccgtacgtaccttaggttcccttcggttaccttacgacccgtttcccg

SEQ ID NO: 272919 - DNA, 729 bp, Homo sapiens
  misc_feature: GYAE6OF02IGO6E.47.76.G10.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcgagggccagtcagagtattagcagactaacttagcctggtaccagacaagaaaccgtgggcaggcctccgaggcctctcatctagtggtcncacgtcccaccgacgggcctacgtggtactcccgagtccgtaggttcgaggtcggacgtaggttcggggtctaggggactaggtacgtttcaccttcgtaccaccgtatccgaaggccaacgtccgtagaccgtagtacgtaggtaacgttagttttacgaactttaaacgtttttaattaaccgttcgttacgaacggttaacgttaaagtttaaacttaaaacgttaacggttaccgggtaccccttaccgggtaaccgtttacccgggaaccggtaaacggggaaccctaaccgggtaaacttaacggggtaacgttaaacgtttaaaccgggaacgttcgggtaacggtaccgttacgaacccgttaaccgtacgtttaccgttaccgtttaccgttaccttaccgttaccccgttaccccg

SEQ ID NO: 272920 - DNA, 529 bp, Homo sapiens
  misc_feature: GYAE6OF02GWJSH.47.76.G10.1.454.CMB.1.raw
  modified_base (195)..(195): a, c, t, g, unknown or other
  misc_feature (195)..(195): n is a, c, g, or t
  modified_base (343)..(343): a, c, t, g, unknown or other
  misc_feature (343)..(343): n is a, c, g, or t
  modified_base (496)..(496): a, c, t, g, unknown or other
  misc_feature (496)..(496): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggtcaggctcccaggctcctcatctatgatgcatccaacagggccacgtggcatcccagacaggttcagtggcagtgggtcngggacagacttcactctcaccatcagcagcctagacgcctagaacgtactttggtacttttatacttgtacagtcagtcgtgacgttctggcctccgcttctcgtttcggcggtagggaccgagggtggagtagtacgaaacggtacgttggnggctaggcaccgtattcgtagttccttgtaccg

SEQ ID NO: 272921 - DNA, 586 bp, Homo sapiens
  misc_feature: GYAE6OF02GPE6K.47.76.G10.1.454.CMB.1.raw
  modified_base (196)..(196): a, c, t, g, unknown or other
  misc_feature (196)..(196): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcagggccagtcagagtgttggcagctacttagcctggtaccaacacgaaacctggaccaggcctcccgaggcctccgtacagtcgtgggatgcactaccgaacgacggggccgctcgggccacgtccccgagccgtagggttccaggtcggactagggttggggtcgtaggggactaggtaccttcaccttctaccacctagtccacgcacgtcctaggacgtccgtagaagtactttagtactttatacgtgtacagctaggtcgtagtcttcgcgcctccgctcgtacgttcgggacggacggtcgagggtgagacgtacgaacggtcgtggcgtctacgacctaccgcgttccgttgtccttcgtacttcccg

SEQ ID NO: 272922 - DNA, 625 bp, Homo sapiens
  misc_feature: GYAE6OF02GUWU0.47.76.G10.1.454.CMB.1.raw
  modified_base (198)..(198): a, c, t, g, unknown or other
  misc_feature (198)..(198): n is a, c, g, or t
tcagagctcacgtacacgaccggtgctcgatttagtcactcatacaggggaggaactgctcagttaggacccagagggaaccatgaaagccccagctcagcttctcttcctcctgctactctggctcccagattccaccggagacattgttttgacacagtctccagccaccctgtctttgtctccgaaggggaaagngccaccctctcctgcagggccagtcagagttgttggcagtctacttacgccttaggtaaccaacgagaaaccgtggaccaggctcccgaggcctcctcagtctatgatcgacactaccgaacgacgggacctacgtggacactcccagccctaggttcgaggtcggacaggtggtagtcgtagggacagtaccttcacttcaccacactacgagcaacgacctaggactccgtagaaagttactttgaccttacttttaatacgttcgtactaagtactaaggtaagtacgacctaacggtccgtaccttccttacgttaccgtttccggggacggtaaccgggaccgtaggggttagaacggtagtaacgaacggaacggtaacgtcggtggaccgtaggacctaaccgtagttccctgttacccg

SEQ ID NO: 272923 - DNA, 640 bp, Homo sapiens
  misc_feature: GYAE6OF02I6I37.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaagcgcccaccctctccgtgcgacgggccagtcagtagtgttggcagctacgttagccgtaggtaaccaacacgaacctggaccaggcctcccgaggcctcctacatctatgatcgactacgtccaacgtacgggaccacgtcggcacctaccccgagacccgtaggttcgaggtacggctaggtcgagtcggtacggactacgtacttaccactccaccaacctataccagccgtaacgtacctaaggaccgtaccgtaaggtaacgttagttttacgaacttacgttttaagttacctgtaacgtacgtaccgtacggtaccgttacgaccgtacgttcgaccctttacgtaccgttacgttcggggacggacggtaccgtagggtcgaagtacgtacggaagtacgagtcggtcgtcgtcgtacctacgtcttacgtgttaccg

SEQ ID NO: 272924 - DNA, 626 bp, Homo sapiens
  misc_feature: GYAE6OF02GCCID.47.76.G10.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (419)..(419): a, c, t, g, unknown or other
  misc_feature (419)..(419): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttagaaacagtctccagccaccctgtctttgtctccgaggggaaanagcccaccctctcctgcgagggccagtcagagttgttggcagcttacgttagcctaggtaaacaacagaaacctggccaggcctcccgagcctccnatctatgatcgacactccgaaacgcgggccctacgtcggcctaacgtccccgaaggtccgtaaggttccgaggtcggactaggtgtacggtcggtagggacctagtacttcacttactacaacctntaccgagcacgtacctagacgtcgtaggaagttctttagacttagtttatacgttgtacagtaacgaaacgttaatccgttacggccctaccgtctaccgtaccggttcgggacggaacgggtacgtaggggtacgtaacgacgtacggaaacgtcgtacggtaggcgtacgaccacgtacgttcgtacgttccttactcgttcccg

SEQ ID NO: 272925 - DNA, 702 bp, Homo sapiens
  misc_feature: GYAE6OF02HZ771.47.76.G10.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagagctcacgtacacgaccggtgctcgatttagtcactcatacaggggaggaactgcctcacgttagggaccctagagggaacctatggtaagccccagcctcagcttactcttcctcctgcctactctggctccagattccaccggngacttattgtttgacactagtctccagccacctgtcttgctccgagggaangccaccgtctctgcaggccaggtcagagtgttcgcagctacttacgccgtggtaaccaactagaaaccttggaccaaggtcctcccgaaggtcctacctctattccgtanggtactggacctacggtaccgaaacggtcggggccctaacggtcgacctacgtccccgtaggtccgtaagggtttcgaggttggacgtagggtcgtaacgtcgtaacgggaactacggtaccctttacgaccgttccgtaccgacctactaccgaagtaccacgtaccgtaacggactcccgttaaaggtaacgtaactttacgaacttaacgtttaacttacgttagtaccgtagtaccgtaggtaccgtacgtaccgtaaccgtcgtacccttacgtaccgttaccggtttccgggacggtaaccgggtaccggtacggtacgggacgtacggtacgacgtaccgtaacgtggtacgtcgtacgacccgtacgtacttccgtagttccg

SEQ ID NO: 272926 - DNA, 667 bp, Homo sapiens
  misc_feature: GYAE6OF02HTU4N.47.76.G10.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (286)..(286): a, c, t, g, unknown or other
  misc_feature (286)..(286): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagactattgttttgacacagtctccagccaccctgtctttgtctccgaggggaangccaccctctcctgcgagggccagtcagagtgttggcagctacttagcctgtaccaanagaacctggccaggcctccgaggtcctcctnacttctatgactgcactaccgaacgcgggaccagtcggactacgtcccgagcccgtaggttcgaggtcgctaggtgacggtccgtagggactacgtaccttccacgttcctaccaccgtatccgacgcgtacgaccctaggaccgtaccgttaggtaaacgtttctttaccgtacgtttaacttttacgttaacgttacgttcgaacggtctaaacgtttactacgtaacgttaaccgtcggtacccgtaccttaccggtacccgtttacgggacccgtaaacgggacctaccggtaacgttggaaacgttaacgttaaacggacgttaggtaccggtacctacggaccgtaaccttcgttacgttacgttccttaacccg

SEQ ID NO: 272927 - DNA, 596 bp, Homo sapiens
  misc_feature: GYAE6OF02GJP1J.47.76.G10.1.454.CMB.1.raw
  modified_base (195)..(195): a, c, t, g, unknown or other
  misc_feature (195)..(195): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccaggggaaanacgccaccctctcctgcagggccagtcagagtgttggcagctacttagcctggtaaccaacacgaaacctggaccaggcctcccgaggtcctcctcatctatgatgcactccgaacgcggcctacgtcggacacgtcccgagtcctaggttcaggtggcgagtcgacgttcgtagggacaggtaccttcactcgtacaccgatcagacacgtccagacgaccgtagaacgtagtttacgaccttatttacttacgttcgttacacgtctagaccgtagtactacgtcgtcctcgttaccgtacgtttaccggacgggtacgggaccgtagggtcggacggtacgtacggaacggaccggtaacgtacgtggtactcggaccgacgtacgttcgttgttacc

SEQ ID NO: 272928 - DNA, 656 bp, Homo sapiens
  misc_feature: GYAE6OF02H0QGE.47.76.G10.1.454.CMB.1.raw
  modified_base (196)..(196): a, c, t, g, unknown or other
  misc_feature (196)..(196): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccatcggagaagttgtgttgacacagtctccagccaccctgtctttgtctccaggggaaagngcccaccctctcctgcagggccagtcagaatattcactcctacttagcctggtaccaacagaaacctggtcaggcctcccgaggcctcctcatctatgatgcactccaacgacgggcccaacgtggacctactaccccgaagaccgtacgggtttacaagggtcggacgtgggttcggggttcgtacggggactaacgtaccttacacgttcctaccaacctactcgaacgtcgtaacgcccgtaaggacgtaccgtacggtaaaggttaccgttttaggtaaccttttaacgtttaccgtggttaccgtagccgaacggttcgggtcgttacggttccgtcggtcccttacccggtcttaccgtacgtttccggggaccggtacgggccgtaggggtacgagtacgtaacgaacggtacgtggtcgtcgtgacctacgtatccgtcgttcttatacccg

SEQ ID NO: 272929 - DNA, 781 bp, Homo sapiens
  misc_feature: GYAE6OF02JGXD0.47.76.G10.1.454.CMB.1.raw
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagactattgttttcgacacagtctccagccaccctgtctgtctctcgaggggaancnccacatctcctggtacgggccgtnagtagttattagcagtacaacgttgcctaggtaccagcaagacggtaccgtgggaccacggtcctacccgaggtcccttaccctcgtaacgttcttagtacggttctcggacctaacgtaacccgaacggaccggggccctaacggttcggaacctacgtacccaaggtacgtacgggttacacggttcggactagggttcggtacggtacgggactaacggtctttacccgacgttaccgtaccaccgtaatccggaacgtacccgtacgggtacccgttaacggaccgttacccgtaaggttaaacgttacgttttaccgtaaccgtttaaccttttaacgtaccgttacgtaccgtaacggttcgtacgggttacggtaccgttaaccgtaaccggttccgttaccgtttccgttaccggttaccgggtttacggggaaccggggttaacgggtacccggtaggggttacggaacggtacgttaaccgggacggtaaccgggttacgcgggttacggtaccggtaaccgtccggtaaccttacgtcccgttaccg

SEQ ID NO: 272930 - DNA, 927 bp, Homo sapiens
  misc_feature: GYAE6OF02INAXW.47.76.G10.1.454.CMB.1.raw
  modified_base (198)..(198): a, c, t, g, unknown or other
  misc_feature (198)..(198): n is a, c, g, or t
  modified_base (878)..(878): a, c, t, g, unknown or other
  misc_feature (878)..(878): n is a, c, g, or t
tcagagctcacgtacacgaccggtgctcgatttagtcactcatacaggggaggaactgctcagttaggacccagagggaaccatggaagcccccagctcagcttctcttcctcctgctactctggctcccagattccaccggagactattgttttgacacagtctccgagccaccctgtctttgtctccgaggggaancgcccaccctctcctgcacgggccagtcaggagtggttggcagaccttacgttacgacccttggtaacccaaacgaacgtaaacccgttcggaccgtaacggtccctaccccgaggtcccttcccttaccacgttaccttaactggtaacttacggcctaaccttaacccgtaaaacccggacggggggtacccctaaccggttaaccgggaccctaacccgttaccccccggaaccgtaccccgggttaaacggggttttacccggtaaacgggttccggggtaaccgtaacgggggttccgttaaacggggtttcccggggttaaacggggggtaaccctaaacgggtttaaccccttttaacccgtaaaccctttaccccggtttaaacccctaaaccccggttaaacctttacccgggtaaccgaacccgttaaccccgggtaaacccggttaaacgggaacccggtttaacccggttaaacggttaaacgtttaacgttttccgtaaaccttttaaaccgtttttacgttaacgtttacgttaccgtaacggtacgtaacggttaccgttacggacccgtaacggttccgtaccctttaccgttaccgttaccgtttaccgggcgggtaaccgggtaccgggtagggtacgaggtaccaggaacgaccggttaanccggtaggtccttaccggaccgtacccgaacgttcgttacgtttacccg

SEQ ID NO: 272931 - DNA, 590 bp, Homo sapiens
  misc_feature: GYAE6OF02G37O6.47.76.G10.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagactatttgttttgacacagtctccagcccaccctgtctttgctccgaggggaaangccacctctccgngcagggccagtcagagtgtggcagctactagcctggaccaagagaacctggccaggcctccagcctccncatctangatcgctatccaacgcgggcccagtcggccacgtcccaagtcctaggttcaggtcggactaggtcggacgtcgtagggaacaggtacttcgactctacacctatcagcacgcctagacgtctagaacgttatttcgacttactttatacttgtactacgactacgcgtaacgactaacggttcgacccttaccgtcttaccggttcgggacggtaaccgggacgtaggggtacgagtacgtacggaacggtacgtacgttcggtcggtaccgtagtaccctacgtacgttccgtagttcccg

SEQ ID NO: 272932 - DNA, 630 bp, Homo sapiens
  misc_feature: GYAE6OF02J2FNI.47.76.G10.1.454.CMB.1.raw
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
  modified_base (420)..(420): a, c, t, g, unknown or other
  misc_feature (420)..(420): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgtttgacacagtctccagccaccctgtctttgctccgaggggaaangccaccctctcctgcagggccagtcagagtgtggcagctacttagcctggtaaccaacgacgaacctggccaggcctccgagcctccncatctatcgatgacactccaagcgggaccacgtggcaacgtccccgagtacccgtaaggttccagggttacggacgaggttacggacggttcggtaacgggaactacggtacttaccgactcccttaccgaacccgtntaccgagccacggtcctaacgcgtcccgtaagtacgttactttcgaacttactttagtacctgtacctgactacgtgtacgacctactcggtccttccgtagttaaccgtttcgggaccggtaagggtcccgtaggggtcgaacggtacgtacggaacggtaacgtacgtacgggtacgcggtacgtcctaacctcgttcggtattcccg

SEQ ID NO: 272933 - DNA, 694 bp, Homo sapiens
  misc_feature: GYAE6OF02FVIF8.47.76.G10.1.454.CMB.1.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcgagggccagtcaagaatattcactcctacttagcctggtaaccaanacgaaacctggtcaggctcccgaggcctcctcatctatgatgcatccaagacgggaccacgtggaccactaccccgagtccctaggttacgaggttcggactaggtaggacgttcggacggggaactacggtactttacgaaccttcctaaccgaccctagtcccgaactccgtaaccggtaacccgttaggaccgtacccgttaaggtaaacgttacgttttacgtaccgtttaaaccgttttaacgtttaccgttacgtactacggtaccgtacggtcgttagggttacgtttccggtaccggtcccgttcccgtcttaccgttaccggtttaccgggccgggtaacgggaccggtaggggtacgaacggtacgtaaccgaaaggtaccgtggttacggtctacgaccgtaaccacgttcgttcgtaccttaccg

SEQ ID NO: 272934 - DNA, 605 bp, Homo sapiens
  misc_feature: GYAE6OF02GB3AF.47.76.G10.1.454.CMB.1.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (319)..(319): a, c, t, g, unknown or other
  misc_feature (319)..(319): n is a, c, g, or t
tcagagctcacgtacacgaccggtgctcgatttagtcactcatacaggggaggaactgctcagttaggacccagacggaaccatggaagccccagcgcagcttctcttcctcctgctactctggctcccagataccactggagaaatagagatgacgcagtctccagccaccctgtctgtgtctccaggggaaanacgccaccctctcctgcagggccagtcagagtattagcagcaattgcctggtaccagcaagaacctgggcaggctccgaggctcctnatcgtanggtgcactccaccagggcctacgtggtacncccagccgagttcagtgggactagggtcggtctagggacagtacgttcactctacgaccagtcacggcacgccgtgtacccgtggtcctaggtaaacgttgttttacgacttaaattttagttacgttcgtacagtactaagttaataacttaacgtcggtccttacggccttccgggaaccgtaacgggaccctaacggtacgtagggtaacgtaacgtttaaaaccggacgttaggtacggaccttacggacctaccggtacttaccgttagttacccgttacc

SEQ ID NO: 272935 - DNA, 260 bp, Homo sapiens
  misc_feature: GYAE6OF02HC1KY.47.76.G10.1.454.CMB.1.raw
  modified_base (253)..(260): a, c, t, g, unknown or other
  misc_feature (253)..(260): n is a, c, g, or t
tcagagctcacgtacacgaccggtgctcgatttagtcactcatacaggggcagttccagacttcactctcaccatcagcagcctagagcctgaagattttgcactttattactgtcagcagcgtagcaactggcctctcactttcggcggagggaccagggtggagatcagacgaactgtggctgcaccatctgtcttcatccttcccgccatctgatacgtgagctctgagcgggctggcaaggcgcatagnnnnnnnn

SEQ ID NO: 272936 - DNA, 734 bp, Homo sapiens
  misc_feature: GYAE6OF02G5UOX.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagactatttggttttgacacagtcctccagcccacccttgttcttttgtcctccgaaggggaaagacgcccaccctctccgtgccgacgggccagtcagtagttggtggcagctacgttacgcctaggtaccaacgaagaaaccgtggaccgaggcctccgacggtcctcctcatctatgatgacctttacaccgaacgacgggcccacgtcggacctaccgtccccgaagcccgttaggttacgacggttggacgtagggtacggtacggttaccggtgggaacgtacggttacctttaccaaccttcctaacccaacccgtacgtaccgtacgaccgaaccgtaccgtaggaccgtacccgtaaggtaaacgtttacgtttccggtacctttaaccgttttaatttaaccgttcgttacgtacggtacgtacggtacgttacgtacgtaaccggtccgtacccctttaccgttccggttaccggttccggggaccgggtacgggaccggttaggggtagacgaacggtacggaacggtacggtacggtggtacggtaccgtacggacctaccctgttaccgttcgttcccg

SEQ ID NO: 272937 - DNA, 574 bp, Homo sapiens
  misc_feature: GYAE6OF02IPWYR.47.76.G10.1.454.CMB.1.raw
  modified_base (196)..(196): a, c, t, g, unknown or other
  misc_feature (196)..(196): n is a, c, g, or t
  modified_base (392)..(392): a, c, t, g, unknown or other
  misc_feature (392)..(392): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggctcccaggctcctcatctatgatgcatccaacagggccacgtggcactcccagccaggttcagtggcagtgagtctgggacagacttcactctcaccatcagcacgcctagacgcctgaagtntttagactactttattacgtgtacagtcagtcgtagacaacgtcggacctctactaccgttttaccgggacggtaacgggacccgtaggggtacggaaggtacgtaaccggtaaaaccggtacgttacggtacggaccgttacggacccgtaaccgtagttccgttacggttcctttaaccg

SEQ ID NO: 272938 - DNA, 742 bp, Homo sapiens
  misc_feature: GYAE6OF02JT6TX.47.76.G10.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccgaccgganaagtttattttgacactagtctccagccaccctgtctttagctccgagggaaancgccaccctctcctgcagggtcaggtcacgagttgttcgacagcctacgttagtcctagggtaaccaagacgtaaaccgtggaccacggtcctacccgnggccttacctacattctaatcgaacgttgacctaactccccaaaggacggtacccgtacgtcggaccgtactaccccgaggtacctacgggtttccgaaggtggactagggttagtccggtactagggaaccgtacgtaaacctttcgaaaccgtttcctaccgaaccttaaccgttcaaaacccggttccgtcccgtacggacgttaacccggttaggtaaacggtaacgtttaacggtttccggaaataacggtttaaccgttaaccgttacttaccgggtacgtaggtaccgttaagttacgtaggtttaccggaactaacgtacgggttacgtaccgggttaccggaaccggtaacggtcggaggttaaccggattaccgacggtactaagtccgggaacgtcgtaataccgtacgtacgtccgtactttacgtccgtacg

SEQ ID NO: 272939 - DNA, 651 bp, Homo sapiens
  misc_feature: GYAE6OF02FKCC4.47.76.G10.1.454.CMB.1.raw
  modified_base (193)..(193): a, c, t, g, unknown or other
  misc_feature (193)..(193): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (369)..(369): a, c, t, g, unknown or other
  misc_feature (369)..(369): n is a, c, g, or t
  modified_base (480)..(480): a, c, t, g, unknown or other
  misc_feature (480)..(480): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtcttgtctccagggaaangccaccctctccgtgcagggccagtcagtgtgttggcagccttacttacgccgttaggtaacccaacgagtaaacccctggacccaggccctcccgaggtcctcctcatctacgtnactnactactaccaacgaggtcccagtcggacactcccgagccctaggttcaggtcgacnggtacgacgttgacgggtacaggtccttacaccgttccacctaccatccgagccacggcctagaccgtacgtacgaacgttactttcgtaaccttaccgtttaatttaccncgttactaaccgcgtacgtacgtaacgtcctaacgtcgtaccctttctaccgttaccgttacgggacgggtacggaaccggtagggtagtacgacgttaacgaccggtaaaccgtacggttcggtcgggtaccttacggccccgtaacgtaaccgtttccgtcgttacccg

SEQ ID NO: 272940 - DNA, 718 bp, Homo sapiens
  misc_feature: GYAE6OF02FLCHZ.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccacctgtctttgctccaggggaagcgccaccctctactgcacgggccagtcagagtgttggcagctacttagccgtaggtaccaacacgaaccgtggaccacggtcctacccgaggtctcccgtctacttcgtatgtactcggactacaccgtaacgcgggacctacgtcggacacctcccgacggtacctagggttcacgggtcgctaggtcgacgtcggtagggactacggtaccttcgaccgttaccctccaaccgttacgtacctaacggacctacggtaaccgtacggaccgtacccgttaaggtaaacgtttacgttttaccggaaccttttaaccgtttttaagttaccgttacgtaccgtacggtaacgtacgttacggtaccgtactaacggttccgtacccttacggttaccttaccgggtttccggggaccgggttacgggaaccggttcgggggtacgtacggtacgtacggaacggttaccgaacggttggtaccgggtactacggtacctaaccggttacgtccgttacttacccg

SEQ ID NO: 272941 - DNA, 759 bp, Homo sapiens
  misc_feature: GYAE6OF02I1QCN.47.76.G10.1.454.CMB.1.raw
  modified_base (194)..(194): a, c, t, g, unknown or other
  misc_feature (194)..(194): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagactattgtttgacacagtctccagcctacctgtcttcgctccgagggaanagccaccctctcctgcacgggccagtcagagttggtagcagctacgttagcctagtaccaacgagaaaccgtggaccaggcctccgaacggcctcccctagacttactagtacgtactcgactactacccgaaacggtacgggccctaacggtcgcctaacctcccggacgcccgttacggttcgacgggttcggacctagggttacggtacggttcggtacggggtaacctacggttacccgtttcgaaccgtccttaacccgaccgttaactccgaacgggtaccgtaaccggtaccgtaacggtaccggtacctaaacgggttaaacgtttacggtttcggtaaccttaaccgttttagttaaccgtttcgtaacgttaccgtaccgtacggtacggtaacgttacccggtaaccgttcggtcccttaccgttaccgtaccgggtttccgggacggtaaccggggtacgggtacgggtcgggtaactaccggttcggaacggtaaccggtagtacgggtagtaccgtaccgaacggtcccgtacgttacgtaccgttaccgg

SEQ ID NO: 272942 - DNA, 781 bp, Homo sapiens
  misc_feature: GYAE6OF02HH45Z.47.76.G10.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctgtctctccgaaggggaaanacgccaaccatcctcctggtacggggccgtcagagttattagcatctaacttagcctaggtaccagcagagaccgtgggcaggctcccgaggcctcccgtnactctatgatgcatccaaggcggaccacgtcggcacgtcccgagtacgtaggttcaggtcggactagggttcggggtactaggggaacctagggtacctttacctacgttaccgtccaacctacgttaccgacgtaccgaacggtcccgtaacggtaccggtccgttaaaggtaaaccggttaaccggttttaacgggttaaccttttaacgttaccgtttaggttacctaggtacgacgggttcggttacggttaacggttccggttaccggtcccgtttcccgggtaccctttaccggtttaccgggtttacccgggccggggtaaccgggggttaaccggtacgggggggtacgggtaaaccgggtaaccggttaaaccggtaaaacccgggttaacggttacgggtttacgggtttacccgggaaccgttaacccggtaaccggttttaccggtttaacggtttcccgtttaaccccgg

SEQ ID NO: 272943 - DNA, 814 bp, Homo sapiens
  misc_feature: GYAE6OF02JMTZ3.47.76.G10.1.454.CMB.1.raw
  modified_base (141)..(141): a, c, t, g, unknown or other
  misc_feature (141)..(141): n is a, c, g, or t
  modified_base (198)..(198): a, c, t, g, unknown or other
  misc_feature (198)..(198): n is a, c, g, or t
  modified_base (462)..(462): a, c, t, g, unknown or other
  misc_feature (462)..(462): n is a, c, g, or t
tcagagctcacgtacacgaccggtgctcgatttagtcactcatacaggggaggaactgctcagttaggacccagagggaaccatggaagccccagctcagcttctcttcctcctgtctactctggctccagattcaccggngacattgttttgacacagtctaccagccaccctgttctttgtctaccgaggggaaangcccacccttctcctgccagggccaggtcaacgagttcggttcggcacgtcgttaacgttacgccgttaacggtaccaaacgaacgtaaaccttcgggaccctagggtacccttccccgtaacggggtccttaccgttaccctaagtttcccgttaaggttacgtaaacgttcggtaccttaacgttaacccgaaacggacgggcccctactacgggaccctacgtaccccgaggtccgtagttaccggagtcggactacgggngtactcgacgggaactagcctttacacgttccgtaccgaacgtcgttaacgacgtacgtaccggtaccttaaggacccgtacgtaagtacgtttaaccgtttcgtaccggttaacttttaccgttacgtttaccgtacctacggtacgtacggtaccgttacggaaccgttacggtaccggtccttaccggttacgttacccggtttaccggggacggtaacgggtaccgggttaagggtccggtaacggtaccgtaaccgggtaacggtaaccggtaacggttcccggtaggttccccgtaaccgggttacctaccccggggtttaacttcccggtttaccgtttaaccgg

SEQ ID NO: 272944 - DNA, 581 bp, Homo sapiens
  misc_feature: GYAE6OF02GHH6U.47.76.G10.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (310)..(310): a, c, t, g, unknown or other
  misc_feature (310)..(310): n is a, c, g, or t
  modified_base (363)..(363): a, c, t, g, unknown or other
  misc_feature (363)..(363): n is a, c, g, or t
  modified_base (390)..(390): a, c, t, g, unknown or other
  misc_feature (390)..(390): n is a, c, g, or t
  modified_base (430)..(430): a, c, t, g, unknown or other
  misc_feature (430)..(430): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccactggagacatttgttttgacacagtctccagccaccctgtctttgtctcaggggaaanagccacctctcctgcagggccagtcagagtgttggcagctacttagcctaggtaccaanagaaatcgtggcaggctcccaggcctctcatctgggatgcatccaagacgggccgntggcactcccagcctaggttcagtgcaggtggtctgggacagtactcgactcncacatcagcagctagacgctagaagtntttgactagtttacttactgtacagcgtagtataggtacnccttaccctagtttccctacggttttcccggaccgttacggggtaacctaaggggttcggtagttaccgtaaccggtaaacgggtaaccttcggggtacggtaccgtacggaccgtaaccgttcgtaccgtttgttacctttacgtacccg

SEQ ID NO: 272945 - DNA, 828 bp, Homo sapiens
  misc_feature: GYAE6OF02IG3Q8.47.76.G10.1.454.CMB.1.raw
  modified_base (143)..(143): a, c, t, g, unknown or other
  misc_feature (143)..(143): n is a, c, g, or t
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccgganacatttgttttagacacagtcctaccagcccacccttgttctttgtcctccgaaggggaaacncgcctacccctctcctagccgacgggccagtcaggtagttggttgacagtcctacttagcctaggtaccaacgaacgtaaccgtggtcaggcctaccgagcctccgntaactctatgatcgactacgtaccaacggtaccggtcctacgtcggtactaccgttaccgagtaaccgtacggttacgaaggtcggtaccgtagggttacgggtcgtagggaccgtaacttaccgttaccgtaccgttaccttaccgaacctcgttacgacgtaccgtaaggtaccgtacgacggtaccttaacgggtaaactttaccggttttaaggtttaaaccgttttaacgtttcggtaacggttaccggtaactacgggttaaccgggttcgtttaacgggtacgggtttccggttacccgggttcccgttacccggtttaccgttaaccccggtttaacgggttccgggggaaaccggggttacggggtaaccggttaggggtaacgggaacttaacccgggtaaaccggtaaaccggttaacgggttcgggtaccggtaacccgtttaccgaacccgtacgggtttaacccgttttcggtaacggttttcccttaacctttacccggg

SEQ ID NO: 272946 - DNA, 832 bp, Homo sapiens
  misc_feature: GYAE6OF02HQ7ZC.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagacttccaccggagactatttgttttgacacagtcctccagtcccacccttgttctttgtcctaccgaaggggaaagacgcccaccctctcctgcgagggtcagtcagtacgttgttgacagtcttacttagtcgtaggtaccaaggacgtaaaccgtcggaccgacggcctacccgaggtcccttacctacgtacgttcgtagggtactcgacctaacctaccgaaacggaccggggccctcgtcgggacctaaccgtcccccgaaggtcccgttaacggttccgtaaggtcgggtaccgtagggttcggggtaccggtacgggaaccgttacggtaccctttccgaaccgtttacccgtacccgaaacccgttagacccgtacggtacccaccggtaccttaacgggtaccgtaacccgttaacggtaaacggtttaccggtttttacggttaaaccttttacgtttaaccgtagttaaccgacgtaccgtagttcggttaacggttcggttccgtccggtacccgttcccgttcgttaccgttaccgggtttccgggaaccggggttaacggggtaccgggtaggggttaacgaacgttaccgtaaaccggtaaaccggttcggttacgggttacggaccgttaaccggacccttacgttacgtccgtttaccgttacctttaccgacccgtttccccg

SEQ ID NO: 272947 - DNA, 466 bp, Homo sapiens
  misc_feature: GYAE6OF02IRD2I.47.76.G10.1.454.CMB.1.raw
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
  modified_base (340)..(340): a, c, t, g, unknown or other
  misc_feature (340)..(340): n is a, c, g, or t
  modified_base (410)..(466): a, c, t, g, unknown or other
  misc_feature (410)..(466): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagcccacctgtctttgtcctccgaagggggaaanacgccaccctcgtcctgcgagggccagtacagagttgttggcagcttaacgttagcctaggtaaccaacgaacgtaaacctgggaccacggcctacccgaaggcctaccctnactctatgactcgacactaccaaacggnggaccctaaggtcggactacctacccgagtacccgtaggttcacggttcgggactagggtacgtacgggnnnnnnnnnnnnnnnnnnnnnnnnnnnnnnnnnnnnnnnnnnnnnnnnnnnnnnnnn

SEQ ID NO: 272948 - DNA, 670 bp, Homo sapiens
  misc_feature: GYAE6OF02IQWF2.47.76.G10.1.454.CMB.1.raw
  modified_base (491)..(491): a, c, t, g, unknown or other
  misc_feature (491)..(491): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgttctttgtctccaggggaaagagcccaccctctcctgcacggccagtcagagtgtggcagctacttgcctggtaccaacgacgaacctggccaggcctaccccgaggcctccgtacacttctatgtatcgactactaccgaacgagggccctacgtcggcacctccccacgtcctaggttcaggtcggactaggtcgtaggttccgtagggtaactacggtacttcacgttcctaccgaccctatcagccacggtacccgtaagacgtactaggtaacgttgtttactaccgttaacgtttattacgtcgtacgngtacgtacggtcgtaacgtaccgttaaaccgtcggtccccttacgttccgttaccggtttccggggacgggtaacgggtaccggtaggggttacggaacggttacgtcgggtaaacggaacgttacggtacgggttccggacgtttccgacgtacccttaaggttccttaggtttaccc

SEQ ID NO: 272949 - DNA, 626 bp, Homo sapiens
  misc_feature: GYAE6OF02FGSZ7.47.76.G10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagactattgttttgacacagtctccagccaccctgtctttgtctccgaggggaaanagccaccctctcctgcacgggccagtcagngtgttcggcagctacttagcctaggtaccaagacgaaacctggcccaggcctcccgaggtcctcctcatactatgatgacactccaagcggccagtcggacactcccgagccgtaggttcaggtcggctagtgacgtcgtagggactagtactacacttcaccactagtcaacgcaacgaccgtaagacgtaccgtagtaacgttactttcgacttaacctttttattaacgtcgttactacgtacgtacgtaccggttacgaaccgtacgtcggtacccttacgtacccgtttaccggttcgggaccggtaacggggaccgtaggggtacgaagtactacggaacggtaaccgtaacgttggaggtccgtacgacctaccctagttccgtcgttaccc

SEQ ID NO: 272950 - DNA, 600 bp, Homo sapiens
  misc_feature: GYAE6OF02FIOS6.47.76.G10.1.454.CMB.1.raw
  modified_base (287)..(287): a, c, t, g, unknown or other
  misc_feature (287)..(287): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgtttttgacacagtctccagccaccctgtcttttgtctccaggggaaagagccaccctctcctgcagggccagtcagagtgttggcagctacttagtctggtaccaagagaaacctggccaggcctccaggcctcctnactcgtgggatggcatcccaaacgagggtcccgctaggcactccccgagccgtagggtttcaagtggctagtggggtctgggaccgagacttcactcgtcacatcagcagcctagacgtccaggaacgttattttcgacttagtttacttacgttgctagtcaaagtaaacttacgtcggccgttacgccttctaccgttttacggcgggtaacgggtaccagggggtcgaccgtaagtagaaaaccgaacgttcgtacgggaccgttcgtacaaccgtagttactcggttctactacgttcccttaccccgg

SEQ ID NO: 272951 - DNA, 310 bp, Homo sapiens
  misc_feature: GYAE6OF02GA78X.47.76.G10.1.454.CMB.1.raw
  modified_base (236)..(236): a, c, t, g, unknown or other
  misc_feature (236)..(236): n is a, c, g, or t
  modified_base (275)..(310): a, c, t, g, unknown or other
  misc_feature (275)..(310): n is a, c, g, or t
tcagagctcacgtacacgaccggtgctcgatttagtcactcatacagggggcagttccagacttcactctcaccatcagcagcctagagcctgaagattttgcacttttattactgtcagcagcgtagcaactggcctctcactttcggcggagggaccagggtggacatgaaacgactgtggctgcaccatctgtcttcatccttccccgcatctgatacgtgactctgtacggnggccggtcgtcggacgacggcccgatatagatgcattgnnnnnnnnnnnnnnnnnnnnnnnnnnnnnnnnnnnn

SEQ ID NO: 272952 - DNA, 824 bp, Homo sapiens
  misc_feature: GYAE6OF02JZVGO.47.76.G10.1.454.CMB.1.raw
  modified_base (142)..(142): a, c, t, g, unknown or other
  misc_feature (142)..(142): n is a, c, g, or t
  modified_base (193)..(193): a, c, t, g, unknown or other
  misc_feature (193)..(193): n is a, c, g, or t
tcagagctcacgtacacgaccggtgctcgatttagtcactcatacaggggaggaacttctcagttaggacccagagggaaccatggaagccccagctcagcttctcttcctcctgctactctggctcccagattccacgganacattgttttgacacagtctccagccacctgtcttgtctccgaggggaaangccaccctctcctgcagggccagtcagagtgttggcagctacttagcctggtaccagccacaaaccgtggccaggcctacccaggtaccctaccgtacaacgttctaacgtcggacccgactaacttcccgaaggccgtaaggggaccctaacggttgggaaccctacgttaccccgaaggtaaccctaacggtttccaaagggttccggaccgtaggggttacgggggttaccgtaaggggggtaaacctacggttaaccgttttaccgaacccggtttaccgttaaccaaacccgtagttacccgaacgggttaccgaaacgggtaccgtacgggtaaaccggtacccgttaaacgggtaaacggtttaacgttttacggaacccgtttaaacggtacggttttaaccgttacgtaaccgggttaacgtaacgtaacggttaacggttaacggtaacgggtaaccgtacccgtttacccgtaacgtttacccggtacccggtttacccgggacccgttacgggaaccgttaacgggtacgtacgttaccggtaaccgtaaaccggtcgtacggtaccggtacgtacgacccttacggtaccgttcgttacgttaccgttacgttaaccg

SEQ ID NO: 272953 - DNA, 695 bp, Homo sapiens
  misc_feature: GYAE6OF02GOUSJ.47.76.G10.1.454.CMB.1.raw
  modified_base (196)..(196): a, c, t, g, unknown or other
  misc_feature (196)..(196): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgacacagtctccagccaccctgtctttgtctccgaggggaanagccaccctctcctgcagggccagtcagagtgttggcagctacttagcctaggtaccaacagaaacctggaccaggcctcccgaggcctcctcatctatgatgcatacccaacgacgggacccacgtcggacctacgtccccagcccgtaggttcaggtggctaggtgacgtcgtagggactaggtacttaccaccttctaccgaacctactaccgaacgtaccaacggtacccgtaaggtaccggtaccgtaaggtaaacgttacgttttacggaacctttacttttaactttaccgttacgtaccgtagtacgtacggtacggttaacgaccgtaaccgttcggtacccttccgtaccgttaccggtttccgggaacggggtaacgggtaacccgggtaggggtacgggaacggtacggtaccggtaaggtaaccggtaacgttacgggtacgggtacgtaccggtaccgtaccgtacgttaccgttacgttacccg

SEQ ID NO: 272954 - DNA, 934 bp, Homo sapiens
  misc_feature: GYAE6OF02HUVC0.47.76.G10.1.454.CMB.1.raw
  modified_base (197)..(197): a, c, t, g, unknown or other
  misc_feature (197)..(197): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccgaccggagacatttgttttgacacagtctccagccaccctgtctttgtctccgagggaaanacgccaccctctacctgcgaggccagtacagtaatattcactccttactagcctcggtaccaacgacgaaaccgtggtaccacggtcctcccgaaggtcctcccgtactagttccgtaggggtacttcggactaacgttaccccaaaacggtaccggggtcccgcgttaacgggacctaccgtacccccgaggtacccgtacggtttaccgaaggttaccgggcgttaacggggttcgggtacccgtagggggtaaacccctagttacccggttttaacccaacgtttaccccggtactaaacccgttagttacccgaaacggacccgtaacggtcccgttaaaggtacccggtccgtttaaaggggtaaaacttttcgtttttaacgggacctttttaaaacggtttttaaccggtaacgttaccgtaaccggttaaacgttaaaccgtaaaaccggttttaaaaccgtaccgggtaccggtacccccggtttacgtaaccccgttttaacgggttaacccgggtttttacccgggggaacgggggtaaacccgggggttaaccgttaccggggggttaaacgaaaccgttaaacggttacccgggaaaaaccgggtccggtttacgggtaaccggggttacccgtaaccggtccccgttaaaccttaggtttacccgttttaccgtaacccgtttttaccccgaacctttttccccggttaaacccccgtaaccg

SEQ ID NO: 272955 - DNA, 313 bp, Homo sapiens
  misc_feature: GYAE6OF02HG60I.47.76.G10.1.454.CMB.1.raw
  modified_base (274)..(274): a, c, t, g, unknown or other
  misc_feature (274)..(274): n is a, c, g, or t
  modified_base (283)..(313): a, c, t, g, unknown or other
  misc_feature (283)..(313): n is a, c, g, or t
tcagagctcacgtacacgaccggtgctcgatttagtcactcatacaggggcagttccagacttcactctcaccatcagcagcctagagcctgaagattttgcactttattactgtcagcagcgtagcaactggcctctcactttcggcgggacgggaccgaggggtggagagtcagaccgaactggtgctgcacatctgtctcactccttcccgctatcctgtactacggtgagccttacgtggacggccggggtcgtacgggacgaagggccncgaagtggnnnnnnnnnnnnnnnnnnnnnnnnnnnnnnn

SEQ ID NO: 272956 - DNA, 631 bp, Homo sapiens
  misc_feature: GYAE6OF02FWV44.47.76.G10.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (475)..(475): a, c, t, g, unknown or other
  misc_feature (475)..(475): n is a, c, g, or t
  modified_base (498)..(498): a, c, t, g, unknown or other
  misc_feature (498)..(498): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagactattgttttgacacagtcctccagccaccctgtctttgtctccgagggaaagngccaccctctcctgcaggccagcagngtgttggcagctactagctggaaccaacagaaaccgtggccaaggtcctacccgaggtccacctcgtactctacgtgtatcgactactccaaacgcggcctacgtcggactacctccgacgcgtaacggttcaggtcgactagtacgtcgtcgtaggaactacggaccttacgacctactaccgaactaccgtagacggactacgccgtaagacgtacgtaagtacgttagttcaacttacgtttagtacngttacgactcgtacgcggtaacncccgtaagttcgtacccttcgggtacccttacggggttcgaacgggtacggggtaccgtaaggggtgaactagcccggtaaggaccctttaaggtggacgtccgacggcctaacctgttaccgtcgtttaccc

SEQ ID NO: 272957 - DNA, 671 bp, Homo sapiens
  misc_feature: GYAE6OF02F9T6I.47.76.G10.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (406)..(406): a, c, t, g, unknown or other
  misc_feature (406)..(406): n is a, c, g, or t
tcagagctcacgtacacgaccggtgctcgatttagtcactcatacagggggaggaactgctcagttaggacccagagggaaccatggaagccccagctcagcttctcttcctcctgctactctggctcccagattccaccggagacattgttttgaacacagtctccagccaccctgtcctttgtctccgaggggaaangccacccgtctcctgcaggccagtcaagngtgttggcagctacttagcctggtaaccaacgagaaacctggacccagggccttacccgaggtcctccgtanacttcgtaacttggatcgactactaccgaacgacggggaccctaagtcggacctacgtaccccgaaggtccctaaggggttcacggtaggcctggacgtacgtcgngggaacagtaacttcgacttaccgactaaccgtaattccgagtaccacggtaccctaagggtccacgtagtaaacggtactttagaccttacgttttataccgtgttaccgatccgtaaggtacgttaacgacgtaaccgttcggtacccttcgtaaccgttcggttacgggacggtaaccgggacgtaacgggggttgacgtaacgttcggaacgtacggtaaaccggtgtggtaacgcaccggtactacgttccggttgtacc

SEQ ID NO: 272958 - DNA, 869 bp, Homo sapiens
  misc_feature: GYAE6OF02GXFRT.47.76.G10.1.454.CMB.1.raw
tcagagctcacgtacacgaccggtgctcgatttagtcactcatacaggggaggaactgctcagttaggacccagagggaaccatggaagcccagctcagcttctcttcctcctgctactctggctccagattccaccggagactatttgttttcgacactagtctccgacgcctaccttgttctttcgtcctccggaaggggtaaacgacgccacccttctcctgcgacggccagtcgagtagtgttggctacgtcttacttacgccttacggtaaccaacgtaacgtaaaccgtcggaccgaacgggtccctacccgtaagggtcccttacccgttaccgtaaacgtttccgttaacggttacggtaacgttacggtacctaaaccgttaaccccggaaaacgggtaccggggtaacccaaccggtttaacgggaacccttaaaccgttaccccggaacggttacccggttaaggggtttaccgaacgggttacgggacgtaacgggttcggtaacggttccggttaggaaaccgttaacgtaaccgttaccgtaaccgttcgtaaccctaaccgtacgtacccggtagtaccgtaaccgtaccgtaaggtacccggtactaaggttaaacgttcgttttacgaaccgttttaaccgtttaaagttcccgttacggtaacgaccggtacgtaaccggttcgtaacgtaacgttaacccgttcgtaaccctttcctacccggtttacggttacgggaccggtaacgggtacggttaccgggtagttaacggtaccgtaacggtaacggtaccggttaacgtcgggtcggtaccgtacgtaccgtaccggtcttaccggttcgttacccg

SEQ ID NO: 272959 - DNA, 783 bp, Homo sapiens
  misc_feature: GYAE6OF02JRTVZ.47.76.G10.1.454.CMB.1.raw
  modified_base (146)..(146): a, c, t, g, unknown or other
  misc_feature (146)..(146): n is a, c, g, or t
  modified_base (194)..(194): a, c, t, g, unknown or other
  misc_feature (194)..(194): n is a, c, g, or t
tcagagctcacgtacacgaccggtgctcgatttagtcactcatacaggggaggaactgctcagttaggacccagagggaaccatggaagccccagcgtcagcttctcttcctcctgctactctggctccagacttccacggagacnttgtttcgactacagtctccagccaccctgtcttgtctccgagggaancgccaccctcgtccgtgcgacgggcaggtcagagttgtcggcacgcttaactgccgtaggaccagacgaacctgggccaggtcctccgaggtcctcacgactactagtcgctacggactacgtacccgaacgacggccgtacgacggactacgtcccctaggtccccgtaggggtttaccaggtccggggtaccagggtccgaacgttccggtaagggggaccctaaaggtccgtttaccgaccggtacctaccgtacccgagtacgtacccggacgtaccggtaaccgttacgaccggtaccgttaggaacgtttacgtttacggtaccgtttaacgtttaacgttaccgtttacgtacgtaccgtacgtaccgggttacgaacggttacgtaaccggttccggtacgttaacccttaccgtttaccgggtttaacccgggaaggggttacccggggaaccgggttacggggtacgggtaacggtaccggttaaaccgggaaccgttaaccggtaaccgggttttccggaccggttccgggttacgtaccccggttaacggtacggttaccttaccgggttttacccg

SEQ ID NO: 272960 - DNA, 744 bp, Homo sapiens
  misc_feature: GYAE6OF02F7POY.47.76.G10.1.454.CMB.1.raw
  modified_base (198)..(198): a, c, t, g, unknown or other
  misc_feature (198)..(198): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagataccaccggagaagtttattttgacacagtctccagccacccttgtctttgtcctccgaggggaanacgccaccctctcctgcgagggtcagtcagagtgttagacagctacttagtctaggtaccaaggacgaaccgtggaccaggcctccgaggcctcctcatcgtgggtatcgacactaccgaacgaggggcctacgtcggcactacccgacgccctaagggttcaggtcggacgtaggttcgggtcgtacgggacgacgtacttccgaacttcacctaccgattccgagccaacgtaccgtaaggaccgtacgttaaggtaaacggttgtttttaccgacggtttaatttttaacgttacttacggttaccgtaacgtaaacccgttaaacggtttaaacgttccgttaccgggtacccttacccgtacgttaccttaccgggttaccgggtaccggggaaccggggttacccggtaggggtacgtaaccggtaagttaacccgggtaacgtaaccggttcgggtaacggtccgttaaccgggacctaaccgttaccgttcggttacgtttacccgtttacgtacccgtttacccggttcccgtaccg

SEQ ID NO: 272961 - DNA, 669 bp, Homo sapiens
  misc_feature: GYAE6OF02HJPD1.47.76.G10.1.454.CMB.1.raw
  modified_base (196)..(196): a, c, t, g, unknown or other
  misc_feature (196)..(196): n is a, c, g, or t
  modified_base (647)..(647): a, c, t, g, unknown or other
  misc_feature (647)..(647): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagacattgttttgacacagtctccagccaccctgtctttgtctccgaggggaaangcccaccctctcctgcgagggccagtcagagtattagcatctaacgttgcctggtaccagcaggacgaccgtgggcaggcctacccgaagggccttccgtcacttcctaatggactcggccgtaccgaccgacggggcctaacgttcgggtttaccccaggtccctagggttccaggtcggcaggtcgcgtcgtgggactaggtacgttccactctaccaacctactaccaactcgtccctagacctagttcgtaggtaacgttagttttaggacgttaaggttttaacttacgttagttaccgacgtctaaggttactcgtaaacttaacgtccggtccgtaccgtacgttacccgttaccgggaaccgtaaacgggaccctaacggtaccgttagggaacgttaaaccgttaaaccggacgttggtacggtaccttagaccgtaacctnttccgtcgtttacctcgttacc

SEQ ID NO: 272962 - DNA, 728 bp, Homo sapiens
  misc_feature: GYAE6OF02GXPCG.47.76.G10.1.454.CMB.1.raw
  modified_base (115)..(115): a, c, t, g, unknown or other
  misc_feature (115)..(115): n is a, c, g, or t
  modified_base (144)..(144): a, c, t, g, unknown or other
  misc_feature (144)..(144): n is a, c, g, or t
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagagctcacgtacacgaccggtgctcgatttagtcactcatacaggggaggaactgctcagttaggacccagagggaaccatggaagccccagctcagcttctcttcctcctnctactctggctcccagagaccactggaanaaatagtgatgacgcagtctccagcccaccctgtctgtctctcgagggaancgccacatctctggtacgggccgtnagagtatagcatacaacttcgcctcggtacagacagacgccgtggcacggtcctcccgacggtccttcctactactacttatggtacgtcggacccgtccaaccggacgggtacccctacgtttcccggtttacccacggtcccgtaacgggttcacggtcggtcgtaggtcggtcgtacggtacgggacaggtcttaccacttcctacctaacctactacaacgcgtacctcgtactacgttacgtagtaagtttacgtttcgtactttaagtttacgtttacttgtactacgtacttaagtacttaacgtaacgttaccgtccggtacccttaccgtacccgttacccgggtaaccgtaacccgggtaacggtacccgtaaccgggttaacggttaaccggggttaaacggttaaaccggttaaaaccgggttacgtacggggtttccgtacccggttaaccgacccgtttaaccgttccggttttaccgtacccgtttaacccgg

SEQ ID NO: 272963 - DNA, 796 bp, Homo sapiens
  misc_feature: GYAE6OF02IHIBC.47.76.G10.1.454.CMB.1.raw
  modified_base (194)..(194): a, c, t, g, unknown or other
  misc_feature (194)..(194): n is a, c, g, or t
  modified_base (427)..(427): a, c, t, g, unknown or other
  misc_feature (427)..(427): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattccaccggagactattgttttgacacagtctccagccacctgtctttgtctccgagggaangccaccctctcctgcgacgggccagtcagtagtgttggcagtcctacttacgcctacggtaaccaacgaacgtaaaccgtcggaccaagggtccctacccgaaggtcctaccgtcactctagtgtaatcgaccaacttacccgaacgacgggcccaacgtcggaccacgtaccccgagtacccgtaggtcgaggtcggcgaggtgtacgtcgagggacacgtacgttcactcnctacctacgtcgacgaccgtacgtccgtaacgtacgtaccgtaggtaacgttacgtttacgtaacgtttaaccgttttaacgtttaccgttacgtacgtacgtaccgtacggtaaccggttacggtaacccgtaccggttacccgtacccgttaccgttacccgttaacccgggttttaccggggacccggggttaaacggggtacccgggttaacgggggtaccggggtaacggttaacgggtacccggtaaaccgggttaaacccgggttaaaccgggttccgggttaaccgggttaccggtaacccgggttaccccggtaaacccggtttaacccggtttacccggtttaccggtttaacccccgg

SEQ ID NO: 272964 - DNA, 674 bp, Homo sapiens
  misc_feature: GYAE6OF02IUS0C.47.76.G10.1.454.CMB.1.raw
  modified_base (158)..(158): a, c, t, g, unknown or other
  misc_feature (158)..(158): n is a, c, g, or t
  modified_base (165)..(165): a, c, t, g, unknown or other
  misc_feature (165)..(165): n is a, c, g, or t
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagattcccaccggagacattgttttgacncagtccncagcccacctgtcttgctccgagggaangccaccctctcctgcngggccngtcagngtntggnagctactanctgaccaanagaactgcagctccagctccncatctatgatgctacnccaagacggtcacgtcggcacgtcccgagtccgacgttacgacggttcggacgtaacggtacgacggttacggtggggaaacctacggttaaccttcggtaacttaccggttacccaccgtaacgttccgacggaacctacggtaaccgttacgaaccggtaccgttacggtaaacggtttacgttttaccgacgttttaacgtttacgtttacgtttacgtacgtaacgtcgtaacggtacgtacgtaactaaccggttccgtacccttccgttccgttaacggttaccgggtccggaacgggtaccggtagggtacggaacgtcgtaacggacgtacggtaacggtgtacggtaccgtacgaccgtacgtacgttcgttcgttaacccg

SEQ ID NO: 272965 - DNA, 513 bp, Homo sapiens
  misc_feature: GYAE6OF02F6T5F.47.76.G10.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (300)..(302): a, c, t, g, unknown or other
  misc_feature (300)..(302): n is a, c, g, or t
  modified_base (307)..(307): a, c, t, g, unknown or other
  misc_feature (307)..(307): n is a, c, g, or t
  modified_base (309)..(310): a, c, t, g, unknown or other
  misc_feature (309)..(310): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (317)..(318): a, c, t, g, unknown or other
  misc_feature (317)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
tcagagctcacgtacacgaccggtgctcgatttagtcactcatacaggggcagttccagacttcactctcaccatcagcagcctagagcctgaagatttttgcacttttatactgtcagcagcgtagcaactggcctctcactttcggcggacgggaccagggtggagatcaagacgaacgtgtgactgcaaccatctgtcttcatctccgccatctgactacgtganctctggacgcgggcttacggntaaacgggngacaattagcgnacgatcagctgcanacgaagntacngancnnntgtanannancnctnnanananacganacgacgagnacgacncanacatatanacgacganacacgacacagtaagtacgacgtaatacgacgtacgacgagacgtagtacgactacacgtatacacgtacgtagttaagagtacgtaaccgaacgtacgtaccgaacgtaacgtagtacgtagtaagtaacttaacgtacgtaacgtaag

SEQ ID NO: 272966 - DNA, 755 bp, Homo sapiens
  misc_feature: GYAE6OF02IBSDJ.47.76.G10.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
tcagagctcacgtacacgaccggtgctcgatttagtcactcatacaggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtgngtcgngggggaggcgtcggtccagtccgtggggtacggtcccgtgacgtactctccgtgtgcacgcctgtggacttccaccttctacgttactaattactagtcgcctacgttcggggtcccgccgtaacggtcctaccgagggacggtaacgggggtcgtagggacggttgggggtcgacgtagttaagtactagtaagttatacggaagttagggaacgcgaacgactactaagtaacgtttaaccaccggtaaagtcccgttaccgggtaacggtaaccgggtacctaacgtttaccaaccgtaacttacctaccgaaggaaaccgttaacgtaaacgtttaaacgggaaaccctaaaccgaccgtactttaacgggttacttaccgtaacgtaacaaacggttacgaaacgtaaccggacgttacgggacgtacggtaccggtaacggaaacgggtaccggaaacgggttcccgttttaagggtttaacgtttttcccgggttaggttacgggtaaccgggtaacggtaacgggtaaggttaaccgg

SEQ ID NO: 272967 - DNA, 667 bp, Homo sapiens
  misc_feature: GYAE6OF02HJLP5.47.76.G10.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagactagtttgttttgacacagtctccagccaccctgtctttgtctcgagggaancgccaccctctcngcgagggccagtcagagtgttggcagtcctactgcctagtaccaacgacgaacgtcggccaggcctaccgaggccttacgtctagtctacgtgtacgtcgaactaccgaacgacgggtccctacggtcgaccgtactccccgaacgtaccgtaaggttcgacggttcgagaacggtggaggttcggtaggacctaggttacttccgacttactaccgactacgtacgacgtccacgtaccgtagtacgtacgtagttaacgttatttacgactttaacgtttacttaccgttagtctagtacgtaggaccgtacgtaacacgttccggtacctccgttaccgttacgttcccgggggaacggtacgggtaaccggtagggtcggacggtacgtacggtaacggtaacgtacggttaggcggtacctcggaccgtacctagtcttacgttccttaccg

SEQ ID NO: 272968 - DNA, 797 bp, Homo sapiens
  misc_feature: GYAE6OF02GKUTD.47.76.G10.1.454.CMB.1.raw
tcagagctcacgtacacgaccggtgctcgatttagtcactcatacaggggaggaactgctcagttaggacccagagggaaccatggaagccccagctcagcttctcttcctcctgctactctggctcccagattccgaccggagactatttgttttgacactagtcctccagccctaccctgttctttgtcctccggaagggaaagacgccctaccctctcctgcgtacgggtcagtcgaagtagttgttagacgacgtccgttaacttacggtcgtacggaacctaaacgtaaccgtaaaccgtcggaccccgtacgggtacccctacccggacggacccttcccgtacgtaacccgttcggtagggacttaccggacctaacgtaaccccgaacgggtaccggggacccggtcgtcggaccctaccgtacccccggaacgtaccgttacggttaccaacgggttccggagtaccgggttcggggtccggtaaggggaccctagtttaaccccgttctaccttacgtaccccacgtactacgacgtccgaacgtcgtacgcgtacgtacgtatttacgttacgttacgttactttacgttacgtacgttacgtaagtaccgttaaacgttaaacgtccgttaccggtcccgttaccgttaccttacccgttacggtttcgggaccgggttacggacggtacggtaacgtaacgaagtacgtaacgttacggtcgtacggtcacgtaccgtactaccgttcgttaccgtaccgttccgttacccgttcccgtacccg

SEQ ID NO: 272969 - DNA, 798 bp, Homo sapiens
  misc_feature: GYAE6OF02F1JMH.47.76.G10.1.454.CMB.1.raw
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
tcagagctcacgtacacgaccggtgctcgatttagtcactcatacagggggaggaactgctcagttaggacccagagggaaccatggaagccccagcgcagcttctcttcctcctgctactctggctcccagagaccacgtggagaaatagtgatgacgcagtcctccagcccacctgtctgtctctaccgaggggaaagacgccaccactccgtcctggtacggggccgtacgagagtattanctatacaattacgcctggtaccagcaggacgaccgtggcaggcctcccgaggtcctccnctattctagtcgtactcgccgtcccgaaccggacgggaccctacggttccggttacccgacggtccgtaggttccgaggttacggcgtacggtcggtccggttcggtacgggtaacgtacggtacggttcctaaccttccgtaccctaaacctactacccaaacggtcccgttaccgtagacctaaggttacgttaggtaaacgtttgttttaacggacttttaaacgtttttagttaccgtttaggttacgaacgttaccgttaaggtttacctaaacggttaacttccggttaccgggtccccgtacccgtttacccgttaaccccgggttaccggaacccgtaaacggggaaccgttacccgggtaacggttaaccggggtaaaacgttaaacccggttaaaaaccggggaccgggttaacggttacgggtaccgttaaccccgggtacctttaaccgggtacccgttttaccggtttacctttaaccccgg

SEQ ID NO: 272970 - DNA, 850 bp, Homo sapiens
  misc_feature: GYAE6OF02H965S.47.76.G10.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagagctcacgtacacgaccggtgctcgattttagtcactcatacgaggggaggaactgctcagttaggacccagagggaaccatggaagccccagctcagcttctcttcctcctgctactctggcctcccagacttccgaccggagactatttgttttgacacagtctccacgccacctgttcttgtctccgaagggaacncgccacctctctgcncgggccgtacaggagtagttacgcatacctaacttacgccgtacggtaccacgacgtaggacgaccggtggaccgagtccgtacccgacggtccttcctactacttcgttaagtgactcggtaccgtacccgaaccggaccgggtaccttaccggtttcggtttaccccacggtcccgtacgggtttacgtagggtcgggtcgtacggtcggtcccgggttacggacgggggtaactacggttaaccggtttccaaccgtttccgtaaccctaacccgtacgtacccgtaaaacgtaccgttcccggagtccggtaacttacggtaacgtacggtttagtttacgtacgttttaagttttccgttaaacttccggtaacttacgtaacgttaagttaccgttactaaacggttacgttacccggacccgtttcctaacccgtttacccgggttaacccggaaaccgggttaacccgggtaacggaacggttaaccgggtaaggtaaaccggtttaaaacccggtttaacggaaccggtttacggttacggacccgtttaaccgaacccgttacccgtttaaccggttctttaacccggtttacttttacccggtaccccgttttacccccgg

SEQ ID NO: 272971 - DNA, 800 bp, Homo sapiens
  misc_feature: GYAE6OF02HA2VQ.47.76.G10.1.454.CMB.1.raw
  modified_base (139)..(139): a, c, t, g, unknown or other
  misc_feature (139)..(139): n is a, c, g, or t
  modified_base (209)..(209): a, c, t, g, unknown or other
  misc_feature (209)..(209): n is a, c, g, or t
  modified_base (451)..(451): a, c, t, g, unknown or other
  misc_feature (451)..(451): n is a, c, g, or t
tcagagctcacgtacacgaccggtgctcgatttagtcactcatacaggggaggaactgctcagttaggacccagagggaaccatggaagccccagctcagcttctcttcctctgctactctgctccagcttccacgganactatttgtttgacactacgtctccgacgtccctaccttgttctttgtacctaccggaagggggtaaacncgaccctaccccttcgtccgtacgccggacgggcctagtcgaacgtagttggttgacaggtccttacgttagtctagggttaacccaaggaacgtaaaacccgtgggtaccgacgggtacccttacccggaaccggtccttcccctacctactttaccgtaaacttcggagttcgtacctacctaacccggaaaccggcgggtaccaccgtggccgaccgtaccaggtaacgtcgttaccgnggttcggaggtacggtcgggttacgacgggtaactacgtaccgttcgtaccttctaccgaccttaccgagtaccggtctaaccgtaccggtacgcgttaaccgggtaaacgttacgttaggttttaccgttaacgttttaagttccgtaaggtcgtaacgtacggtacgttaggtcgttaccggttaacggttccgttaaccgtccggttttaaaccgttccgggttaaccgggttacgggaccggggttacgagggggttcgaacgtcgtacggtaacggtaacccgggtagttacgggtcgaccgtacgaccgttacgtcggttaactcgtttccgtatttaccccg

SEQ ID NO: 272972 - DNA, 773 bp, Homo sapiens
  misc_feature: GYAE6OF02JLUR1.47.76.G10.1.454.CMB.1.raw
  modified_base (150)..(150): a, c, t, g, unknown or other
  misc_feature (150)..(150): n is a, c, g, or t
  modified_base (227)..(227): a, c, t, g, unknown or other
  misc_feature (227)..(227): n is a, c, g, or t
tcagagctcacgtacacgaccggtgctcgatttagtcactcatacaggggaggaactgctcagttaggacccagagggaaccatggaagccccagcgcagcttctcttcctcctgctactctggctcccagacacactggagaaatagtnatgacgcagtcctccagccacccttgtctcgtctcctcgaagggaaatcgccacctatcctccgtgtacgggccgtnacggatcgttaagccagtcaaacgttgaccgttcggtaaccacggacgaacggtacggtaccgttacgggccgtaggtaccttacccgaagggtccttacccgtacgtaacgttcgttaacggtcggtaacgttccggtcccggttaccccgtaaccggtaaccggggtaccccgttaaccggttttacccggggtttttaccccgaaccggttacccgttaacggggtttaccgtaacgggttccggtaccggtaccgggtacggtacccggtttcggtaaccggggggtaactaacgggttaccgtttaccggtacccttaaccgtacccgtaaccgacgttaacccgtacgtacgtaccgtcgtaccgtacggttcgttacgtaacgttactttacgtacgttaacggttactttacgttcgtaacgtgtactacgtactacgtactacgtcgtaccgtctacgtccgtcgaacgacgacgcgtacgacgtaacgtaacgtacgaacgttcgtagtactacgactaacgtcttacgcgttacg

SEQ ID NO: 272973 - DNA, 709 bp, Homo sapiens
  misc_feature: GYAE6OF02G4WHO.47.76.G10.1.454.CMB.1.raw
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (368)..(368): a, c, t, g, unknown or other
  misc_feature (368)..(368): n is a, c, g, or t
tcagagctcacgtacacgaccggtgctcgatttagtcactcatacaggggaggaactgctcagttaggacccagagggaaccatggaagccccagctcagcttctcttcctcctgctactctggcctcccagattccgaccggagactatttgtttcgacacagtcctccagcccacccttgtctttgcctcgaagggaanacgccaccctctccngccgaggccagtcgagtagtggtcgcagctacgttacgcctacggtaccaacgaactaaccgtcggcacggctaccccgaggtccctcgtcaacttactagacgtactcaccgtaacgtaccccaaacgtccgggaccctaacggtcggacnccgtacccgacgtccggtacgtacgtaggtcgactagggtacgtacgtcggttaaggactacgtacttcgaacttctaaccgactagtacacgcgtacgaccgtacggactacgtagttaagtttcgtttacgtaccgtttactttagttacgttcgtacgtacggtaccgtaggtaccgtaagtccgttaaccgtcctaaccgttcgtaaccgttccgggttacgaccgggtacggggtacgagggttacgtacggtaacgtcgggaaacctacgggtaacggttcggtaccggacggtttacggaccgttacgtttaccgttcggttaccgttaaccgg

SEQ ID NO: 272974 - DNA, 896 bp, Homo sapiens
  misc_feature: GYAE6OF02IJ43S.47.76.G10.1.454.CMB.1.raw
tcagagctcacgtacacgaccggtgctcgatttagtcactcatacagggggaggaactgctcagttaggacccagagggaaccatggaagccccagctcagcttcctcttcctcctgcctactctggctcccagtacttccaccggagactatttgttttagactacgagtcctccacgtcccacccttgttcctttcgtcgttacccgaaggggaaagtacgaccctaccccttccttccctgcggacggccgacgtcacggtaggttcggttggacctaggtaccttaacgttaccgtcccgttacggtaaacccaaaccgtaaccggaaacccgttacggaccgaccggccctaccccgaccggtacccttaccccgtactacgtttacctaaggttacgtacgtcggaccgtaactaccgaaaccggaccggtaccgaccgtccggacctaacccgtaccctacggtaccgttaacggtaccgtacgggttacggacgtacggtacggtacggttacggtacggaacgttaaccgtaaccgttaccgtaaccgttacccgtaacctaaacccgtaccgtaccgtacccggtaacccgaacgtttaccccgtaaggtaacccggtaaccttaaagggtttaacgttttaacgtttaacctttacccgggttttaaacttttaaccggtttacgtttaccggttaacctcgttaaccggtaacgttaaccggtaaccgtaccggttaaccgttccggttacccgtttacttacccgggtttaccgttacccggggtaccgggtaaccgggtaaccgggtacggacggtaacgaccggtaacgtacgaccgttaggtcggaccgtcgacgtaccgccgtaactccgttacgttac

SEQ ID NO: 272975 - DNA, 740 bp, Homo sapiens
  misc_feature: GYAE6OF02HHS0G.47.76.G10.1.454.CMB.1.raw
  modified_base (721)..(721): a, c, t, g, unknown or other
  misc_feature (721)..(721): n is a, c, g, or t
  modified_base (730)..(730): a, c, t, g, unknown or other
  misc_feature (730)..(730): n is a, c, g, or t
tcagagctcacgtacacgaccggtgctcgatttagtcactcatacgaggggaggaactgctcagttaggacccagagggaaccatggaagccccagctcagcttctcttcctcctgctactctggctcccagtacttccgaccggagactagtttcgtttcgaactacagtcctccacgtccaccttcgttcctttgtcctaccgaggggaaagacgccctaccctcctaccgtgcggacgggcctacgtcaaggtcgtggttcgctagtctactacggaccgtggtaaccaacgaacgtaaccgtcggtaccgacggtcctccggacggcccttaccgtacaacgtttcgtacgttagtaccgtcgtaacctaccgtacccgaaacggcgggtacccctaagtccggacctaaccggtcccgtactccccggttaaggttaccggacggttcggggaaccctaggggttacgtaaccggttcgggtaaccggtaccttaacggttacccgttacgtaacccttcccgtaaccgactacggttaccagtaccgaccgtaccgtaacgacccgtacgtaggaaccgttttacttacggttaactttacgttactggttaccagtcgacgtgtacgtcgttacgtcgtccgtcctacgttaccgttgggttaccgaggtaccgtagcgggttacacgtacgacgaacgtgtacgcgcgtacgntacgacgtntcgtactacg

SEQ ID NO: 272976 - DNA, 898 bp, Homo sapiens
  misc_feature: GYAE6OF02HY4UG.47.76.G10.1.454.CMB.1.raw
  modified_base (215)..(215): a, c, t, g, unknown or other
  misc_feature (215)..(215): n is a, c, g, or t
tcagagctcacgtacacgaccggtgctcgatttagtcactcatacagggggaggaactgctcagttaggaccagagggaaccatggaagccccagctcagcttctcttcctcctgcctactctggcctcccagtacttccgaccggagactatttgttttcgacacagtctccgacgtccctaccctgttcctttcgtcctccggaaggggaaanacgccctacccctcctccgtcgcgacgggtccacgtcgagtagttcggttcggcgacgtcttacgtacgtcctacgggtaaccaacgtaacgtaaaccgtccggaccgaacgtccgtaccccgacgggtcccttcccggtacacttctaacgttcggacttacggacctaaccgttaaccccgaaacggtacccgggggtaacccctaaccggtttaccgggaacccaaccccgttacccccggtaaccgtacccggttaaaccggttccggtaacgggtccggggtaaacgtacggggttacggtcggttacggtaacggggtaaccctaacggtttaaccgttcccgttacgttaccctacccgtaccctaacgtaccgtaacgcgtacccgtaccggtaaccgtaccggttacccgtaaggttaaccgttagtttacccttacggtttaaaccttttacgttaacgttaccgttagtaccggtacttaaccgggtaaccgttacacccggttaacgttcccggtaccgtttacccgttccggtttacccgggttaaccgggtaccgggtaccggtaacggggttacggtacgggttaacgtacggttaccggaaccggtggtaaccggttaggccgttacggtaccgtaccgtacccgtagttcccgttacgttaccccg

SEQ ID NO: 272977 - DNA, 844 bp, Homo sapiens
  misc_feature: GYAE6OF02GF8CE.47.76.G10.1.454.CMB.1.raw
tcagagctcacgtacacgaccggtgctcgatttagtcactcatacagggggaggaactgctcagttaggacccagagggaaccatggaagccccagctcagcttctcttcctcctgctactctggctcccagtacttccaccggagactatttgttttgactacagtcctccagcccaccctgttatttcgtctccgaaggggaaagcgcccacccttcgtcctcgcgacgggcctagtcgagtagtgtggcagtctacttagccgtacggtaaccaacgaacgtaaaccctggtaccctacggcctacccgaggtccctaccgttcacgttactagtgacttcgactaccgttacgaaaccggccggtacctaccggtaaccgccgtaacctccccgaaggccggttacgtttaaccgtacgggtggtacaaggttccggtacggtccggtaaggggtaccaaccggttacttaccccgtaccttaccgttaacccgaaccttacggttaaccccgaggtaccctaacccggttaaccttacgggaacccggtttacccggtaaaaggttaccggtttaacgtttaaccgtttacccgttaaacttttttacgttaaccggttacggttaccgtaccgtacgttaccggttacgtaaccggtccgtaaaccggttccggttacccttacggttaccgtttaaccggggttcccggaaacggggtaccggttaccggggtacggggtacggtaacggttaaccggaccggtaaccggttaaccggtaacggtttccgtaacggccgtaaccggtacgacctttacggttaccgttccgttaccg

SEQ ID NO: 272978 - DNA, 668 bp, Homo sapiens
  misc_feature: GYAE6OF02JIIY5.47.76.G10.1.454.CMB.1.raw
  modified_base (196)..(196): a, c, t, g, unknown or other
  misc_feature (196)..(196): n is a, c, g, or t
tcagagctcacgtacacgaccggtgctcgatttagtcactcatacaggggaggaactgctcagttaggacccagacggaaccatggaagccccagcgcagcttctcttcctcctgctactctggctcccagataccactggagaaatagagatgacgcagtctccagccaccctgtctgtgtctccgaggggaaanagccaccctctcctgcgagggccagtcagagtattagcagctaacttagcctggtaccagcaagaaaccgtgggcacggcctcccgaggcctccgtctactctagtcggtcgcctactccaccgacgggccacgttggtacctcccgagtcccgtacgttcaggtcgcgtaggtggtccgtagggaactaggtacgttccgaacttccgtaccacgtacgtcgacgtaccgagtcccgttagaccgtagtcgtaacggtaaacttacgttttacgaacctttaagttttacttacgtatacgtaacgtacttaacgtaacgttaattaaccgtcgtacccgtcgttacccgttcggaaccgtaacgggaccgtaccggacgttagggaaccgttaacggttaaaaccgtacgttacgggtacgtaccgttacggaccttacccgtacggttacgttacgttacccgttaacg

SEQ ID NO: 272979 - DNA, 677 bp, Homo sapiens
  misc_feature: GYAE6OF02GC893.47.76.G10.1.454.CMB.1.raw
  modified_base (194)..(194): a, c, t, g, unknown or other
  misc_feature (194)..(194): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagagctcacgtacacgaccggtgctcgatttagtcactcatacaggggaggaactgctcagttaggacccagagggaaccatggaagccccagctcagcttctcttcctcctgctactctggctcccagacttccaccggagacattgttttgacacagtctccagccacctgtctttgtctccgagggaancgccaccgtctactgcacggcagtcagtagtgttggcagaccttacttacgcctacggtaaccaacgaacgaaacctcggaccaggtcctaccgaggcctacctcgatctagtgatcgactactaccgaacgcggaccacgtcgacaacgtcccaagtccgtagggttacaggttaggccgtaagtcgtacgtacgacgggactacgtactactacgtacnctaaccgntacgacgtcgaaccgtcgagtaccgacgttagtaacgttctttaaccggactttaacggtttactttaacggactttaacgccgtacggaacgttaccggtaacgtaccgtaacgttccggtacctttaccgtacggtttacccggtacgggaccgggtaagggaccggttagggtacgttaagaccgttaacggaaacggtcctaaaggtttccggacgtacgtaccgaccgtacgtacgttccgtattaccg

SEQ ID NO: 272980 - DNA, 642 bp, Homo sapiens
  misc_feature: GYAE6OF01BFGM0.43.45.E01.1.454.CMB.1.raw
tcagtgtgagtagtcacgaccggtgctcgatttagtgagtcagtaagggaaagggctgggcctgaggaagcagcactggtggtgcctcagccatggcctggaccgttctcctccctcggcctcctctctcactgcacaggctccgtgacctcctatgaactgactcagccccctcggtgtctgtggccccaggacagacggccagcattacctgtggggatacaactttgccagaaaatgtacattggtaatcagcagaaggcaggccaggcccctggcgagtggtcgtcctggtgacgatagggaccgcctcggggatccgttggacgcgattcctctgggctccaagttcgtagggaacacggccactcgtggacccagtccagcccgggtcgagggcccggggacgagggccgacgtagttacgttgtacgaacgtggtgggatcgggtactggtcgaccggttacgtgggtcgtcggacggacgggaccgaggtccgtacggtaccggttaccgtacgggtacgacggcccgtaaacgggccgttaccggaccccccgttgggtacccgtaccgttcccgttcccggttccccctaacccccggttccctaccgtaccccttaccgtcccgtaacccg

SEQ ID NO: 272981 - DNA, 606 bp, Homo sapiens
  misc_feature: GYAE6OF01B3LQE.43.45.E01.1.454.CMB.1.raw
  modified_base (286)..(286): a, c, t, g, unknown or other
  misc_feature (286)..(286): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctggtgtctgtcggcccaggacagacggccagcattacctggtggggatactaactttgacccaagaaaaatgtaacattggtatcagcaagaaggcaggccacggccctgngatggtcgtctgtgacgagtacgggaccggccgtcgggatccgtgagcgtattctcgtggctccgaagtcgtacgggaacacggccactctacgacatcgaggccgggtcgacgggccggggacgacggccgacttattattgtacgtaacgtggtagggtagtggtacgtgggtcgaccggtagtggggtcggtcgggcgggacgggaccgaaggtcgtcgaccgtccgtaggtcgacgaccgaacggcctccggtccccgtcggtcctccgttccgttcccgttccccgtccccttcctacctacctaccgtccaccg

SEQ ID NO: 272982 - DNA, 672 bp, Homo sapiens
  misc_feature: GYAE6OF01B9F9J.43.45.E01.1.454.CMB.1.raw
tcagtgtgagtagtcacgaccggtgctcgatttagtgagtcagtaagggaaaggggctggggccgtgaggaagcagcactggtggtgcctcagccatggcctggaccgttctcctccctcggcctcctctctcactgcacaggctccgtgacctcctatgaactgactcagccccctcggtgtctgtggccccaggacagacggccagcattacctgtggggatacaactttgcccaagaaaaatgtaacattggtaatacagcagaaggcaggccaggccctgtgatcggtcgtctggtgacggagtacgggaccggcccgtcggggatccgtgacgcgattcctcgtggctcctaagtcgtgggaacaccggccactcaggaaccatcgacggccgggtcgacggccggggacgacggccggactacgttagttagtactaacgtggtgggagttggtacgttggtacgtaccggtaacggttcggggtcgttacggggcgggaaggggacccgaagggtccgtacggacccggttaccgtagggtaccgacggaccccgaacgggtccgtccggtccccccgttgggtaccctacccgttcccgttacccggtttacccccctaacccccgttcccttacccgaacccttacccgtcccgtaaaccccg

SEQ ID NO: 272983 - DNA, 686 bp, Homo sapiens
  misc_feature: GYAE6OF01BGSKR.43.45.E01.1.454.CMB.1.raw
tcagtgtgagtagtcacgaccggtgctcgatttagtgagtcagtaagggaaagggctgggcctgaggaagcagcactggtggtgcctcagccatggcctggaccgttctcctcctcggcctcctctctcactgcacaggctccgtgacctcctatgaactgactcagccccctcggtgtctgtggccccaggacagacggccagcattacctgtgggggatacaactttgcccagaaaaatgtacattggtatcagcagaaggcaggccaggcccctgtgatggtcgtcgtgtgacgagtaggggaccggccctcgggggactccgttgagcgattctctggctccaagtctagggaacacggccactctgaccatcgaggcccgggtgacgggccggggacgagggccgacttattagttgtacaacgttggtgggattgggtacgtgggtacgtacccgggttacgtggggttcggtttcgggacgggtacggggaccgaaacgggtccgttacgggaacccggttccgtacggggttacccgaacggtacccccgaaagggtccccgttaccggtccccccccgttacgggttccccgtaacccgtttccccgttcccgggtttacccccccggtcccccctttaccccgttacccctacccttaacccgttccctaaacccg

SEQ ID NO: 272984 - DNA, 728 bp, Homo sapiens
  misc_feature: GYAE6OF01EUPLO.43.45.E01.1.454.CMB.1.raw
  modified_base (179)..(179): a, c, t, g, unknown or other
  misc_feature (179)..(179): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
tcagtgtgagtagtcacgaccggtgctcgatttagtgagtcagtaagggaaaggggctgggcctgaggaagcagcactggtggtgcctcagccatggctggaccgttctcctcctcggcctcctctctcactgcacaggctccgtcgacctcctatgaactgactcacgccccctcggntgtctgtcggcccacggacagacggccgacgcacttaccgtggtggggataactaactttacgaccaaagaaaaatagtacagttaggtatacacgcgaaggaacggacgacggccgacggcccgtgtgntgacgtcgtgtntacgaggacgggacccgggtcccncgggggactcccgtttggacgcgattcgtcttggctccaagtctacggggaacacggaccaactcctcgaccatcncnaccgggtcggagggccgggggacggacgggcccggaacgtacgttacgaaagtacgtaacgcttacggttacggggtacggttacggggttaacggttacgggtttacggggtaacccgggttaaccgggttacgggggttacggggtttaccggggttacgggggtacgggggtaaccgggaaacgggtaccggtacggtaacccggtacccgttaccgggttaccggtacggtacccggaacccgggtaccggtccggtacccccgttcccgggaccgttacccgtacccgttcccgttcccg

SEQ ID NO: 272985 - DNA, 563 bp, Homo sapiens
  misc_feature: GYAE6OF01BJTNO.43.45.E01.1.454.CMB.1.raw
  modified_base (358)..(358): a, c, t, g, unknown or other
  misc_feature (358)..(358): n is a, c, g, or t
  modified_base (528)..(528): a, c, t, g, unknown or other
  misc_feature (528)..(528): n is a, c, g, or t
  modified_base (552)..(552): a, c, t, g, unknown or other
  misc_feature (552)..(552): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctggtgtctgtggccccaggacagacggccagcattacctgtgggggactacaactttgacccagaaaaatgtacattggtatcagcagaaggcaggccaggcccctgtgatggtcgtctgtgacgataggggaccggccctcggggatccgttgagcgattctctggctccaagtctgggaacncggccactctgaccatcacgccgggtcgacgggccggggacgacgggcccgactattattgtctaactgtgggatggtactggtcgaccggtcgtgggtgttcgggcggagggaccgaaggtcgtgacccgtccgtaggtcacgcccaaggcctcgcccccgtcggtccncctcgtcgttcccgccctcctccncctctcctacc

SEQ ID NO: 272986 - DNA, 701 bp, Homo sapiens
  misc_feature: GYAE6OF01DTG2Y.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtggggatacaactttgcccagaaaatgtacattggtatcagcagaaggcaggccaggcccctgtgatggtcgtctgtgacgagtacggggacccggcccgtcggggacttcccgttggacgtcgtaatttccgtccgtgggcctaccgaaaggttccgtacggggaaacccaccgggccctaactcctacggaaccccagttccgaacggcccggggttcggaacggggcccgggggaacggacgggcccggtaacgttattaagtttcgtacgtaaacgttggtagggtagttgggtacgtgggtcggaccgggttacgtggggttcggttcgggacgggagggaacccgaaggtccgtacggacccgttccgtacggtaccgacgaccccgaaacggtcctccggtccccccgttcgggtcctaccgttacccgttccgttaccccctaccccttaccctccctaccttaccgtccgtaacccg

SEQ ID NO: 272987 - DNA, 634 bp, Homo sapiens
  misc_feature: GYAE6OF01AY2LN.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctggtgtctgtggccccaggacagacggccagcattacctggtgggggatacaactttgcccaagaaaaatgtacattggtatcagcagaaggcaggccaggcccctgtgatggtcgtctgtgacgagtaggggaccgccgtcgggatccgttgagcgattctctggctaccgaagtcgtagggaaccacggccacgtctacgacctagtcgacggccgggtcggacgggaccggggacgacggccgtaacttagtttacgttcgtactaacgttgggtagggtacgtaggttacgtgggtacggtaccgggttaggtggggttcgggttacgggacgggagggaccgaagtcgtacggtaccgtccgtacggtacaccggaccgacggtcctcccggtccccgtcgtcctaccttccgtacccgtcccctaccctacctacctacctcctcgtaaacccg

SEQ ID NO: 272988 - DNA, 849 bp, Homo sapiens
  misc_feature: GYAE6OF01CJBPX.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctctatgaactgactcacgccccctggtgtctgtcgccccaggacagacggccagcacttaccgtggtaggggaatactaacgtttcgacccaaagtaaaaatgtaactagttaggtatacgagacaaggaaacggcaacgggccaacggtcccctaggtgagttcgggtccgtctacggttaggacgaaggttaaccggggaccccggtccccggttacgggggtaactttcccgtttaggaaccggtacggtaacgttttccgtaccggttcgggtaccttaacccgtaaacggttccggtaacgggggtaaaccccgtaccggggacccctaaacgttcccgttacggaaccccttaaagttcccggaaccggggtcccgggggttaccgggaaccgggggtcccgggggaacgggacgggtacccgtaagtttaacgtttagttacgtaaccgtaacgttaggggttacgggtaacgttacgggttacgttacggggttacggtaacccgggtttacggttgggggttacggtttccggggacgggtaacggggtaccgaacgggtccgtacggtaccccggttacgtacgggtaccaacggtcccggaaggccgtacccgcccccggttggtacccttcccgtccgttccccgttaccctaccccgttacctacctacccttacctccgtacccg

SEQ ID NO: 272989 - DNA, 715 bp, Homo sapiens
  misc_feature: GYAE6OF01A5XYY.43.45.E01.1.454.CMB.1.raw
  modified_base (358)..(358): a, c, t, g, unknown or other
  misc_feature (358)..(358): n is a, c, g, or t
tcagtgtgagtagtcacgaccggtgctcgatttagtgagtcagtaagggaaagggctgggcctgaggaagcagcactggtggtgcctcagccatggcctggaccgttctcctcctcggcctcctctctcactgcacaggctccgtgacctcctatgaactgactcacgcccccctcggtgtctgtggccccaggacagacggccagcattacctgtgggggatacaactttgcccagaaaaatgtacattggtatcagcagaaggcaggccaggccctgtgatggtcgtctgtgacgagtagggacccggccgtcggggatccgttgagcgtattctctggctcaagtcgtgggaacncggccactctgaccatcgacggccgggtcgacgggcccgggggacgacgggaccgtaacgttagttacgtttacggtactaaacgttggtagggtacgttgggtaacgttggggtacggtacccggggttacgtttcgggggttcgggtttaccggggaccggggtaacggggtaaccccaaacggggtaccgttaccgggtaaccccgggttcccgttaacgggtcccgaaaccggtccccgaaacgggtcccggttccgggtaccccccccgttccgggtaccctacccgttcccttacccggtttacccccctaccccgttccctaccctaacccgttaccctaccgtaacccg

SEQ ID NO: 272990 - DNA, 694 bp, Homo sapiens
  misc_feature: GYAE6OF01BJYMP.43.45.E01.1.454.CMB.1.raw
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
tcagtgtgagtagtcacgaccggtgctcgatttagtgagtcagtaagggaaaggggctgggcctgaggaagcagaactggtggtgcctcagccatggcctggaccgttctcctcctcggcctcctctctcactgcacaggctccgtgacctcctatgaactgactcagcccccctggtgtctgtcggccccagaacagacggccagcattacctggtggggatacaactttgcccaagaaaaatgtacattggtatcagcagaaggcaggccaggccctgngatggtcgtntgtgacgagtacgggaccggcccgtcggggactccgttggacgcgtattcgtctggctccgaagtcgtgggaacacggccaacgtcgacgacctactcgacggcccggggtacgacggggcccgggggacgacgggacccgtaacgttacgttaagtttacggtactaaacgttgggtagggtagttacggggttacgttggggttacggtacccgggttacgttgggggttacggtttccggggacggggtaacgggaaccgaaggtccgtacggtacccgttccgtaacgggtccacggaccccgaagggccgtacccggccccccgttcgggtaccacccgtttccttccgttacccccacccgttcccttaacccttacctcctaaccgtccgtacggg

SEQ ID NO: 272991 - DNA, 639 bp, Homo sapiens
  misc_feature: GYAE6OF01BILG3.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctcggtgtctgtggccccaggacagacggccagcattacctggtggggatacaactttgacccaagaaaaatgtactattggtatcagcagaaggcaggccacggccctgtgatggtcgtctgtgacggagtacggggacccggcccgtcgggggacttccgttggagtcgtatttctcgtggcctaccgaagtcgtacgggaaccaccggccactctcgaccagtcgacggccgggtcggacggggcccggggaacgacgggtaccgaacttagttacgttcggtacgtaacgtggtagggtagttgggtacgtgggtacggtaccgggttaggttggggttacggtcgggacgggacgggaccaaggtcgtacggtaccgtcgtacggtcacgccgacggcctccggtccccgtcggtcctaccgtccgtcccgttcccctcccttcctacctacctctcacg

SEQ ID NO: 272992 - DNA, 635 bp, Homo sapiens
  misc_feature: GYAE6OF01B8JH7.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctcggtgtctgtggccccaggacagacggccagcattacctgtggggatacaactttgacccaagaaaaatgtacattggtatcagcagaaggcaggccaggcccctgtgatggtcgtctgtgacgagtacggggacccggcccgtcggggactccgttgacgcgtatttctcgtcggcctaccgaagttcgtaggggaaaccaccggccaactcgtagaccctatccgacggccgggtcggacgggccggggaacgacgggccgacttagttagttcgtactaacgtggtagggatggtactggtacgaccggtacgtgggtgttcgggcgggagggaccgaggtcgtacgaccgtccgtaggcacggcccgaaggcctccggcccccgttcgggtacctccgttccgttcccggttacccccctacccttccctacctaacccttaccgtcctaacccg

SEQ ID NO: 272993 - DNA, 829 bp, Homo sapiens
  misc_feature: GYAE6OF01ESBOG.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctggtgtctgtcggcccaggacagacggccagcattaccgtggtaggggatactaactttgacccaagaaaaatgtactagttggtatcagcaaggaaggcaggccgacggccctgtgtagtcggtcgtcgtggtgacggtagtacggggcccggcccgtcgggactccgtgacgtcgtattcgtcgtcggtcctaccgagtacggtacgggaaccgaccggacccacgttccgtacgaaccctacgtaccgaaccgggtccccggggttacgggaacccggggggtacccggggggaaccggaaccgggtaccccggttaaacgtttaacgttttaacgtttacggtaaaccgtaacggttacggggttaggggtacggtttacgggttaacccggttggggttaccgggttaccggggttacgggtttcgggggttcgggtttaccgggggaaccggggtaacggggaacccggtaacggtccgttaccgggtacccggttacccggtacgggtacccgaaccggtacccggtaacgggtccccgttacccgggtccccccgttaccgggttacccctacccgttacccgtttccccggttacccccccttacccgtccccgttacctaaccccgttacctcccgtaaacccg

SEQ ID NO: 272994 - DNA, 780 bp, Homo sapiens
  misc_feature: GYAE6OF01A4LZ9.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctcggtgtctgtcggcccaggacagacgccagcattacctggtgggggatactaactttcgacccaagaaaaatgtactagttggtatcagcaaggaaggcacggccacggcccctgtgagtcggtcgtcgtgtgacgagtacggggacccggcccggtcgggactccgttgacgcgtattcctcgtcggcctccgaacgtcgtacggggaaccgaccgggccaccgttcgacgtaacccacgtaccgacgggcccggggtacggaccggggtacccgggggaacgggaccgggtacccgtaacgtttacgtttacgttaggttaaccgtaaacggttgggttacggggtacgttacggggttaacggttcgggtacgggtacccggggtttacggttcgggggttcgggtttcggggaccggggtaacggggaaccgtaacggtccggttaaccggacccggttaccggttacgggtaccggtaccggaacccggtaccggtccgttaccccggtccccccggttacggtcccgtacccgttcccgttccccggtttcccccgtacccccttccctacctaccccttaccgtaccttaacccggg

SEQ ID NO: 272995 - DNA, 741 bp, Homo sapiens
  misc_feature: GYAE6OF01BVFHT.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctcggtgtctgtcggccccaggacagacggccagcattacctgtgggggatacaactttgacccagaaaaatgtacattggtatcagcagaaggcaggccaggcccctgtgatggtcgtctgtgacgagtacgggaccggcccgtcggggactccgttgagcgattctcgtcggctccgaagtcgtagggaaccacggccactctgaccatcacggcccgggtcgacggggccggggacggacgggcccggtaacttaagtttagtttacggtacctaaacggttgggtacggggattgggttaacgttggggttacgtacccgggttaacggttgggggttcggtttccggggcggggtaacggggaacccgaacgggtccgtacgggtaccccggttcccggttacgggtaccgtaaccggaccccgtaaacgggtccccgtaccgggtcccccccggttacgggttccccttaacccgtttccccgttacccggttttacccccccgtaaccccccgtttaccccgtaccccgtaaccccgttaacccgtacccgtaaaccccg

SEQ ID NO: 272996 - DNA, 848 bp, Homo sapiens
  misc_feature: GYAE6OF01BQSR6.43.45.E01.1.454.CMB.1.raw
tcagtgtgagtagtcacgaccggtgctcgatttagtgagtcagtaagggaaagggctgggcctgaggaagcagcactggtggtgcctcagccatggcctggaccgttctcctcctcggcctcctctctcactgcacaggctccgtgacctctatgaactgactcacgccccctggtcgtctgtcggcccaggacgacgacggcagtactacttaccgtggtacggggtatactaacgtttcgacctaaagtaaaaagtcgttaactagttaggtactacgagacgaacggaaacggcgaacgggacccgtaaccggtaccccgtaggtacgtaacggtcggttccgttcgtaggtacggaacggtaacggtaccggggaccccggtaccccggttacggggtaaccgttccggtacggtacggtaccgtaacgttccgttcgtacggtacctaccgtaacggttacggtaacggtaaaccgtaccggaccctacgttaccgtacgaacccgtacgtaccggacgggtacccggggtacgggaccgggggaaccggggtacccggtaacgggtcccgttaaacgtttacgtttaacggtacgtaaccggtaaacggtttcgggtaggtacgggttttacggtacggttaggggttaccggttaaccggttggggtttacggggtacgggtttccgggaacgggtaaccgggaacgtaacgggtccgtacggtaccggtcgtacgggacctaacgggcccgtaaggcccgtacccgggtcccctttggaccttccgttcccgtcccgttaccccctccgttacctacccgtaaccttccgtaccgtacgg

SEQ ID NO: 272997 - DNA, 622 bp, Homo sapiens
  misc_feature: GYAE6OF01BCGXN.43.45.E01.1.454.CMB.1.raw
  modified_base (315)..(315): a, c, t, g, unknown or other
  misc_feature (315)..(315): n is a, c, g, or t
  modified_base (606)..(606): a, c, t, g, unknown or other
  misc_feature (606)..(606): n is a, c, g, or t
tcagtgtgagtagtcacgaccggtgctcgatttagtgagtcagtaagggaaaggggctgggcctgaggaagcagcactggtggtgcctcagccatggcctggaccgttctccctcctcggccctcctctctcactgcacaggctccgtgacctcctatgaactgactcacgccccctcggtgtctgtcggcccaggacagacggccagcattacctgtggggatacaactttgcccaagaaaaatgtacattggtatcagcagaaggcaggccaggcccctgtgatggtcgtctgtgacgagtagggccgcccgnggggactccgtgagcgattctcgtggcctaccgtaacgtcgtgggaacacggcccacgtctcgaccactcgacggcccggggtacgacgggcccgggggacgacgggacccgtacgttacgttattacggtactaacgtggtaggggatgggttaaccgtggtcggtaaccggttcggtagggttggttcgggcgggacgggaccaacggccgtacgcccgttaccgacggttcgacgccgaaggcctaccggcccctggtccacctccgtccgttccccgcccttacccncacctaccgtcaaccg

SEQ ID NO: 272998 - DNA, 792 bp, Homo sapiens
  misc_feature: GYAE6OF01BRCY4.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgccccctcggtgtctgtcggcccaggacagacggccagcattaccgtggtgggggatactaactttcgacccaaagtaaaaatgtaactagttggtatacatcaaggaaggcgacggccacggtcccctgtgtagtggtcgtctggtgacggagtacgggaccggtccgtacgggatccgtgacgtcgtacttctcgtcggtacctacgaacggtccgtacgggaaaccgtaccggaccctacgtccgtacgacccgacgtccggacgggtacccgggggtaccgggaaccgggggacccggggggaacggaccgggtaacccgttaacgtttaacgtttacgttacggttaaccgtaacgtacggggttagggtaagttacgggttacggtacggggttacggtacccggggtttacgttgggggttacggttccggggacggggaaccggtaccggaacgggtcgtaaccggtacccggttacggtacggccgtaaaccggtccgtaacggtcccgttaccccgggtccccgttacggttacccgtacccgtttcccgttaccccggttccccccgtccccgttcccgttaacccttaccccttacccgttccgaacccggg

SEQ ID NO: 272999 - DNA, 736 bp, Homo sapiens
  misc_feature: GYAE6OF01EQIYW.43.45.E01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (722)..(722): a, c, t, g, unknown or other
  misc_feature (722)..(722): n is a, c, g, or t
  modified_base (730)..(730): a, c, t, g, unknown or other
  misc_feature (730)..(730): n is a, c, g, or t
tcagtgtgagtagtcacgaccggtgctcgatttagtgagtcagtaagggaaagggctgggcctgaggaagcagcactggtggtgcctcagccatggcctcggaccgttctcctcctccggcctcctctctcactgcacacggcctccgtcgacctcctatacgaactcgacctcaccgcccccgttcggtcgtcgtcggtccggcccgaggacgagaccggcagactacttaccgtggtggggactactaacttcgaccaaagaaatntactagtagtacnagagaagacgacacggccaccgtccgtgtgtagtcggtcgtgtaggtgacggacggtaccggggtacccggccggttacggacgttccgtagacgtacgttacttcgtcgtcggacctcggaaggttcggaacggacccgacgtccgtacgtacgtacacgtacgccggtacggggtacccgggagggaccggggaccgggaacggaccgtaccgttaaactttgttaacgtttcgtaaccgtaagttcggggaacggttgttcggtacggtttaggaccggttaccggtgggttacggtgggtaccggggaacggaacggaccgtaagtcgtaacccggtcgtaacccggtagtacccggacgtacccggtaccggtcccgtacccccggtctcccgggttactccccggttccgtccgtcccccttacctccgtaaccncgttaccncgaccg

SEQ ID NO: 273000 - DNA, 807 bp, Homo sapiens
  misc_feature: GYAE6OF01B2X2W.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgccccctggtgtctggtcggcccaggacagacggccagcattaccgtggtaggggatactaacgtttcgacccaagaaaaatgtaactagtttaggtatcgaagacgaaggaaacggacgaacgggacccgaacggtccccgttagtaggtagttcgggtccgttcgtggtaggaaccggtaacggtaccgggggaccccggtcccgggtacggggtacttccggttagggacgtcgttacgtttccgtcgttacggtcctaccgtaacggttcggtaacgggaaccgtacccggacctacgtaccgtacgtaccgacgttacggaccgggtcccggggtacgggaacgggggtccggggaaccgggacgggtacccgttaacgttaagtttacggttagtaaccgtaaggttcgggtagggtacgttacggggttacgtcgggtaccggtacgggttaccgggttgggttccgggtacgggtaccggggaacggtaaccgacggtaccggttaccggtacccgttacggtacggtccgaccggaccgtaaccggtccgtccccggtccccgttccgtaccgtcccgttccgttacccttacccccgtcccttaccctacctacctacctccgtaaccg

SEQ ID NO: 273001 - DNA, 841 bp, Homo sapiens
  misc_feature: GYAE6OF01C9L0H.43.45.E01.1.454.CMB.1.raw
  modified_base (410)..(410): a, c, t, g, unknown or other
  misc_feature (410)..(410): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcaccgcccccgtggtgtctcgtcggcccaggacgacggacggccagcacgttaccgtggtggggatactaactttcgaccaaagaaaatgtactattggtatcagacaggaaggcgaggccgacggccctggtgagtcggtcgtcgtggtaggacgagtaccggggtaccggtcccggtacggggtactcgttgacgtcgtacttcgcgtcggtactaccgtaagttccggtaacggggaaaccnccgggacctacgttaccgtaccgtaaccacgtaccggaccggggtcccggggtaccggaccgggggtaacccgggggaacggaaccgggtacccgttaaacgtttaagtttaaccgttcgttaaccggtaacggtttggggtacgggtattacggggttaacggttcggggtaccggttaaccgggtttcgggttggggtttaccgggttcgggggaaccggtaacggggaaccgtaaggtccggttaccgggtacccgtttacgggtaccggtaccgtaacccgggtaccccggtaacggtccccggtacccggtacccccccggttaccgggttacccgtttacccgttaccccgtttcccccgttaacccccccgtccccgtttaccccgtaaccgttaaccccgtaacccgttacccgtaacccggg

SEQ ID NO: 273002 - DNA, 873 bp, Homo sapiens
  misc_feature: GYAE6OF01BBY03.43.45.E01.1.454.CMB.1.raw
  modified_base (825)..(825): a, c, t, g, unknown or other
  misc_feature (825)..(825): n is a, c, g, or t
  modified_base (851)..(851): a, c, t, g, unknown or other
  misc_feature (851)..(851): n is a, c, g, or t
tcagtgtgagtagtcacgaccggtgctcgatttagtgagtcagtaagggaaaggggctgggcctgaggaagcagcactggtggtgcctcagccatggcctggtaccgttctcctccgtccggcctcctctcctcactgcacaggtcctccgtacgtacctctagtcgaactgacctcgaccgtcccccgtggttcgtcgtcggtccggacccgtaggaccacggaccggccaggacttacgttaccggtggggtacggggtaacttaaccgttacgttaccgaaacccgtaaaagtaaaacgttcggttaaacgttacggtttacggtactaccgtaacggacgtaaagggaaccggcgaacccgggtaccgaccgggtcctaggtaggtcgttccggttcgttacgtcggacgacggtaccgggaccggggcccggtccggttaacgggtccttccggttaggtaccgacgtttacttccgtcgttaccggtacctaccggtaaaggtccggtaaccgggaaaccggtaccgtacctccgtcggttaaccgacctacggtaccggaccgggggttccgggaccgggggacccgggtaacccggggggactaccgggtaccttagttaacgttattacccgttagacggttagggtacggtcgtacgggtttaccggtgggtttacccgtacggggttcgttcgggggttaccgtaacggggacggggtaaaccgttccggccggttaccggtttaccggacggtttaccggacggtacggtaccgaccggtttaccgccccgttaccgtccccgtagttacccncccggttacccttccgacccttcccncgttacctcgtacgtccgtacg

SEQ ID NO: 273003 - DNA, 539 bp, Homo sapiens
  misc_feature: GYAE6OF02GST5V.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtgggggatacaactttgcccagaaaaatgtacattggtatcagcagaaggcaggccaggcccctgtgatggtcgtctgtgacgatagggaccggccctcggggatccttgagcgattctctggctccaagtctgggaacacggccactctgaccatcagccgggtcgagggccggggacgacggccgactattattgtcaactgtgggatggtactggtgaccggtactgggtgttcggcggagggaccaagctgaccgtcctaggtcagcccaggctcggcccctcggtcactctcgtcccaccctcctccactaccactacg

SEQ ID NO: 273004 - DNA, 557 bp, Homo sapiens
  misc_feature: GYAE6OF02GYP9I.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtggggatacaactttgcccaagaaaaatgtacattggtatcagcagaaggcaggccaggcccctgtgatggtcgtctgtgacgatagggaccggcccgtcggggatccttgagcgattctctggctccaagtctggggaacacggccactctgaccatcagcccggggtcgagggccggggacgaggccgactattattgtcaactggtggatggtactggtgaccggtacgtgggtgttcgggcggagggaccaagcgtgaccgtcctaggtcacgcccaggcctcggccccctcggtccacgttcctcgttccccacccttccctccacttacctcaacc

SEQ ID NO: 273005 - DNA, 224 bp, Homo sapiens
  misc_feature: GYAE6OF02GGGF9.43.45.E01.1.454.CMB.1.raw
  modified_base (221)..(224): a, c, t, g, unknown or other
  misc_feature (221)..(224): n is a, c, g, or t
tcagtgtgagtagtcacgaccggtgctcgatttagtgagtcagtaagggaaagggggagagactgaagaacccagcattgcagcagctccaccatggcctgggctcctctgctcctcaccctcctcagtctcctcacaggtcagcccaaggctgccccctcggtcactctgttcccgccctcctcactactcacactgagcgggctggcaaggcgcatagnnnn

SEQ ID NO: 273006 - DNA, 544 bp, Homo sapiens
  misc_feature: GYAE6OF02I1FUG.43.45.E01.1.454.CMB.1.raw
  modified_base (454)..(454): a, c, t, g, unknown or other
  misc_feature (454)..(454): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtgggggatacaactttgcccagaaaatgtacattggtatcagcagaaggcaggccaggccctgtgatggtcgtctgtgacgatagggaccggccctcggggatccgttgagcgattctctggctccaagtctgggaacacggccactctgaccatcagccgggtcgaggccggggacgacggccgatagttattgtcaactggtggatggtactggtgaccggtactgggtgttcgggnggagggaccaagcgtgaccgtcgtaggtcacgcccgaaggctcggcccctcggtcacctcgtcgttcccacccttccaccactactccac

SEQ ID NO: 273007 - DNA, 856 bp, Homo sapiens
  misc_feature: GYAE6OF02I45QO.43.45.E01.1.454.CMB.1.raw
tcagtgtgagtagtcacgaccggtgctcgatttagtgagtcagtaagggaaaggggacgtgggccgtgaggaaggcagcactggtggtgccgtcagccatggcctggaccgttctcctcctcggcctcctctctcactgcacaggctccgtgacctcctatgaactgactcagcccccctcggtcgtctgtggccccaggacagacggccagcattacctgtggggatacaactttgcccagaaaatgtacattggtatcagcagaaggcaggccaggcccctgtgatggtcgtcgtgtggacgagttacggggacccggtcccgtcgggggaattcccgttggaaggcgtatttccgtcgtcgggccttaccgaagtcgtacggggaaacaccgggcctaaccgttctacggaaccctaacgttccgaacgggcccgggggttaccgaaacgggggtcccccgggggggaacggaaccggggaccccgggtaaccgttaacggttttaacgtttacgttaccgaaaccggtttagggtacgggggtaattacgggggttacctttacgggggtacggttaaccccggggtttaaccgttggggggtttacgggttttacccgggggtaccgggggtaacggggggtaaccccgtaaaacgggtccggttaccgggtaaccccgggttaccggtttaacggggtacctaaccgggtaccccggtaacgggtcccgttcccgggccccccccggtttacgggttcccgaacccgtttcccggttacccggtttcccccccggttcccccgtttacccccttaccgtaaccccgtttaccccgttccctaaaccccgg

SEQ ID NO: 273008 - DNA, 637 bp, Homo sapiens
  misc_feature: GYAE6OF02INIAS.43.45.E01.1.454.CMB.1.raw
  modified_base (357)..(357): a, c, t, g, unknown or other
  misc_feature (357)..(357): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagccccctcggtgtctgtggccccaggacagacggccagcattacctgtggggatacaactttgcccaagaaaaactgtacattggtatcagcagaaggcaggccacggccctgtgatggtcgtctgtgacgatacgggaccggccctgggatccttggagcgtattctctggcctcaagtcgtaggaacncggccaactcagaccatccgaggccggtacgacgggccggggaacgacggcccgaatattagttgacgtaacttggtagggtattggtactgggtactaccgggttacgtagggtcggttcgggacgggtacgggaaccaacggcgtggaacccggttccgtagggtacaacggcccgtaagggcccgttcggaccccccgttggtacccgtaacgttcccgttaccggttccccccgtacccgttccccttacccgaaccgttacccgtcctaacccgg

SEQ ID NO: 273009 - DNA, 225 bp, Homo sapiens
  misc_feature: GYAE6OF02HKH9O.43.45.E01.1.454.CMB.1.raw
  modified_base (222)..(225): a, c, t, g, unknown or other
  misc_feature (222)..(225): n is a, c, g, or t
tcagtgtgagtagtcacgaccggtgctcgatttagtgagtcagtaagggaaagggggagagactgaagaacccagcattgcagcagctccaccatggcctgggctcctctgctcctcaccctcctcagtctcctcacaggtcagcccaaggctcgccccctcggtcactctgttcccgccctcctcactactcacactgagcgggctggcaaggcgcatagnnnn

SEQ ID NO: 273010 - DNA, 564 bp, Homo sapiens
  misc_feature: GYAE6OF02IFK51.43.45.E01.1.454.CMB.1.raw
  modified_base (357)..(357): a, c, t, g, unknown or other
  misc_feature (357)..(357): n is a, c, g, or t
  modified_base (559)..(559): a, c, t, g, unknown or other
  misc_feature (559)..(559): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtggggatacaactttgcccagaaaaatgtacattggtatcagcagaaggcaggccaggcccctgtgatggtcgtctgtgacgagtaggggaccggccctcggggatccgttgagcgattctctggctcaagtcgtgggaacncggccactctcgaccatcaggcccgggtcgacgggccggggacgacggccgactattattgtacaactgtgggatggtactggtcgacggtacgtgggttcgtcgggcgggtacggaccgaagcgtgacccgttccgtaggtcagcccgaggcgtcgccccctcggtcctactccgtcgttccccaccttccctcacctccnctacc

SEQ ID NO: 273011 - DNA, 249 bp, Homo sapiens
  misc_feature: GYAE6OF02HL4E0.43.45.E01.1.454.CMB.1.raw
  modified_base (226)..(249): a, c, t, g, unknown or other
  misc_feature (226)..(249): n is a, c, g, or t
tcagtgtgagtagtcacgaccggtgctcgatttagtgagtcagtaaggggaaagggggagagacgtgaagaacccagcattgcagcagctccaccatggcctgggctcctctgctcctcaccctcctcagtctcctcacaggtcagcccaaggctcgccccctcggtcactctcgttcccaccctcctcactactcgacactgacgcggctggcaaggcgcatagnnnnnnnnnnnnnnnnnnnnnnnn

SEQ ID NO: 273012 - DNA, 573 bp, Homo sapiens
  misc_feature: GYAE6OF02I5757.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctcggtgtctgtggccccaggacagacggccagcattacctgtggggatacaactttgcccaagaaaaatgtacattggtatcagcagaaggcaggccaggcccctgtgatggtcgtctgtgacgagtaggggacccggcccgtcgggggatcccttggagcgtattcctctggctccgaagtctgggaacacggcactctgaccatcagccgggtcgacgggccggggacgacggccgactagttatgtctaacgtggtagggatgggttactgggtgtaccggtacgtgggtggttcgggcggagggaccgagcgtacgaccgtcgtacggtcacgccgaggctcgccccgtcggtcctacgtctcgttcccaccctcctccaccgtactcctaccg

SEQ ID NO: 273013 - DNA, 602 bp, Homo sapiens
  misc_feature: GYAE6OF02GG2PE.43.45.E01.1.454.CMB.1.raw
  modified_base (423)..(423): a, c, t, g, unknown or other
  misc_feature (423)..(423): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctctgtgacctcctatgaactgactcagcccccctcggtgtctgtggccccaggacagacggccagcattacctgtgggggatacaactttgccagaaaaatgtacattggtatcagcagaaggcaggccaggcccctgtgatggtcgtctgtgacgatagggaccggccctcggggactccgttgagcgtattctctggctccaagtctgggaacacggccactctgaccatcagcccgggtgacgggccgggacgacggccgactattattgtacaactgngggatggtactggtgaccgggtactggggttgttcgggacgggagggacccaaaggtccgtaggacccgtccgtaggtcgacggacccgaaggtccgtcggccccccgttcgggtcctaccgttccgtaccggtttccccccaaccccgtttcccgtaccctacccgttacctaccccg

SEQ ID NO: 273014 - DNA, 596 bp, Homo sapiens
  misc_feature: GYAE6OF02I33CY.43.45.E01.1.454.CMB.1.raw
tcagtgtgagtagtcacgaccggtgctcgatttagtgagtcagtaagggaaaggggcgtgggcctgaggaagcagcactggtggtgcctcagccatggcctggaccgttctcctcctcggcctcctctctcactgacacaggctccgtcgacctcctatgaactgactcagccccctggtgtctgtcggcccaggacagacggccagcattaccgtgtggggatacgaactttcgccagaaaatgtacattggtatcagcagaaggcaggccgaggcccctgtgatggtcgtcgtgtgacgagtacgggccggaccgtcggggatccgttgacgcgattctcgtggctcaagtctggggaacacggcacgtctgacatcacgccgggtcgaagggccggggacgacgggccgaacgttagttattggactaaacgttggtagggtattgggtacgtgggtacgaccggttcgtgggttcgggttcggcgggacggtacgaacgcgtacgaccgttcgacggtcacgccgagccgtcgtcccccggcgttcgacctccgttcgtccccacccttcctaccgaccttaccgactaccg

SEQ ID NO: 273015 - DNA, 659 bp, Homo sapiens
  misc_feature: GYAE6OF02JN6G8.43.45.E01.1.454.CMB.1.raw
  modified_base (380)..(380): a, c, t, g, unknown or other
  misc_feature (380)..(380): n is a, c, g, or t
  modified_base (650)..(650): a, c, t, g, unknown or other
  misc_feature (650)..(650): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtcggccccaggacagacggccagcattacctgtgggggatacaactttgcccagaaaaatgtacattggtatcagcaggaagcaggccaggcccctgtgatggtcgtctgtgacgatacgggaccggcccgtcggggacttccgttgagcgtattctcgtggcctccgaaggtcgtagggaacacggccactcgtnaccagtcaggccgggtacgacgggccggggacgacggaccgtacttagttacgttcgtacaacgttgggtagggtacgtagggttacgtgggtacggtaccgggttacgtcggggttcggttccggggcgggtagggacccgaagtccgtacggtacccggtccgtacggtaccgaccgaccccgtaggccgtcccggtcccccgttcggtacctacccgttccgttcccgttccccctaaccccggttccctacccgtaccgttacccncgtaacccg

SEQ ID NO: 273016 - DNA, 705 bp, Homo sapiens
  misc_feature: GYAE6OF02IOUQY.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtgggggatacaactttgcccaagaaaaatgtacattggtatcagcagaaggcaggccaggcccctgtgatggtcgtctgtgacgagtacggggaccggcccgtcggggactccgttgagcgtattctcgtggcctccgaagtcgtaggggaacaccgggccactctacgaccatcacggcccggggtacgacgggccgggggaacgacgggacccgtaacgttagttacgttcggtactaacgttgggtagggtagttgggttaacgttgggtacggtaacccgggttacggttggggtcggttacgggaccggggtaagggaacccgaaagggtccgtacggacccggttaccggttaacgggtacccgaacgaccccgaacgggtcccgttacccgggtccccccggttaccgggtacctacccgttccgtttacccggttaccccccaccccgtttccctaccctaaccttacccgtacctaacccg

SEQ ID NO: 273017 - DNA, 793 bp, Homo sapiens
  misc_feature: GYAE6OF02FW5DG.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctggtggggatacaactttgcccaagaaaaatgtacattggtatcagcagaaggcaggccacggccctgtgatggtctctgtgacgagtacgggaccggcccgtcggggtacttccgttagacgcgtaattcctcgtcggcctaccgaagtacgtacggggaaaccaccggacccaacgtctacgaaccacgtaccgacgggcccggggttacggaaccgggggtcccgggggaacggacgggacccgtaacgtaaacgtttacgtttcggtactaaacgttgggtacgggtagtttcgggttaaccgttgggtacggtaacccgggttacggttgggggtttacggtttccgggggacggggtaacgggtaacccgtaagggtccggttacggtaaccccgggttaccgttaacgggttacccgaaccgggtacccccggtaacgggtcccgttaccccgggtacccccccggttaccgggttacccgtaaccccggttttcccgttaccccgggtttacccccctaacccccgttacccccggtacctaaaccccggttaccctacccgtaaaccccgg

SEQ ID NO: 273018 - DNA, 650 bp, Homo sapiens
  misc_feature: GYAE6OF02GOOUJ.43.45.E01.1.454.CMB.1.raw
  modified_base (641)..(641): a, c, t, g, unknown or other
  misc_feature (641)..(641): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctcggtgtctgtcggccccaggacagacggccagcattacctggtgggggatactaactttgcccaagaaaaatgtacattggtatcagcaagaaggcaggccacggcccctgtgatggtcgtctgtgacgagtacggggaccggcccgtcggggactccgttggacgcgtattccgtcgtcggctccaagtcgtagggaacacggccactctcgaccatcgacggcccggggtacggacgggccgggggaaccgacgggcccgtaacgttagtttattacggtacaacgtggtagggagttgggtactgggtacggtaccgttaggtgggtcgttcgggacggggacggaccgaaggtccgtacggaccgttccgtacggtccgaacggcccgaggtccgtccggtcccccgtacggttccaccgttcccttcggttcccccgccgttccctaccgacctttaccnccgtaaccg

SEQ ID NO: 273019 - DNA, 776 bp, Homo sapiens
  misc_feature: GYAE6OF02HCV4K.43.45.E01.1.454.CMB.1.raw
  modified_base (707)..(707): a, c, t, g, unknown or other
  misc_feature (707)..(707): n is a, c, g, or t
tcagtgtgagtagtcacgaccggtgctcgatttagtgagtcagtaagggaaggggctgggcctgaggaagcagcactggtggtgcctcagccatggcctggaccgttctcctcctcggcctcctctctcactgcacaggctccgtgacctcctatgaactgactcacgtccccctggtgtctgtcggaccccaggacacgaccggacacgctacttaccgtgggtacggggtaataacgtaactttacgacccgaaaagtaaaaagtcgtaacgtagttaggtaactcgagacgtaaaggaacgggacgacggtaccgacggtacccctggttaggaagtcgggttcgtcgttaggtcgaacggtaacgtacggggacccggtacccggtcggggtaacttccgttaggacgacggttacttcgtcgtacggtactacgtaacgtcggtacgggaaaccgtcggacccagttaccgtacgaactacgtacggaccggtacccggggtacggaccggggtaccgggaacggacggtaaccggtaaacttacgttaacgttcggtaacctaaggtgggttagggtacgttagggttacggtacgggttacggaccgtttagggtcgggttacggttacggggacgggaaccgggtaacgacggtacgtaccggtaccgttacggtaacgcgtacgtaccgacggttccncccggtccccgtagcctaccgttcctccggttaccccaccttacccgtacctacgtacctacgtaaccg

SEQ ID NO: 273020 - DNA, 748 bp, Homo sapiens
  misc_feature: GYAE6OF02IUHQR.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgcccccctggtgtctgtcggccccaggacagaccggccagcattacctggtgggggatacaactttcgacccaagaaaatgtacattggtatcagcagaaggcaggccaacggccctgtgatggtctctgtagacgagtacggggacccggcccgtcggggattcccgttgagcgtattctcgtggtcctaccaaggtccgtacggggaaaccaccgggacctaacgtctacggaaccctatcgacgggtcccgggtaccgggaacggggtacccgggggacggacgggtacccgtaagttaacgtttaagttcgtaccgaaacggttgggttacggggagtttacggtaacgtttggggtaccgttaccgggttacggttggggttcgggtttacgggcggggtaacggacccgtaagggtccgtacgggacccgtttacggtacggttaaccgaggtaccccgaagggtccgttaccccggcccccgtttaccgggtccttaacccgttccggtttaccccgttaccccccgttccccgttacccgtacccgtaacccgttacccgaccctaacccgg

SEQ ID NO: 273021 - DNA, 817 bp, Homo sapiens
  misc_feature: GYAE6OF02I22OQ.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgccccctcggtgtctgtcggcccaggacagacggcagcattaccgtggtggggactactaactttcgaccaagaaaactcgtactacgttggtactctacggacagaacggacgacggtaccgaccggtcccgttagtgtaacgttggtccgtcgttaggtacggtaacgtacggtaacgggggacccccggtacccggtccggggtaacttccggttaggaacgtcgtaacgtttccgtcggtccggtcctaccggtaaacgtccggtacggggaaaccgtaccggacctaaccgttccgaacgtacctaacgtccgacgggtcccggggtacggacgggacccggggggacgacccgggtacgtaaaccgtttagtttacggttcgtacctaacggtggtacggggtacttacgggttaacgttcgggtaaccgggtacccgggtttaggttcggggttaaccgggttcggggtaacgggaaccggggtaacctaaacggggtccgtaaccgggtacccgttaccgttaacgggtcccaacgggaccccgtacggcccgttcccggtcccccggtttacgtccgtacccttcccgggttcccgttacccccctccgttaccgtacccctaacgttcccaacctaccg

SEQ ID NO: 273022 - DNA, 657 bp, Homo sapiens
  misc_feature: GYAE6OF02FMXWL.43.45.E01.1.454.CMB.1.raw
  modified_base (239)..(239): a, c, t, g, unknown or other
  misc_feature (239)..(239): n is a, c, g, or t
  modified_base (260)..(260): a, c, t, g, unknown or other
  misc_feature (260)..(260): n is a, c, g, or t
  modified_base (390)..(390): a, c, t, g, unknown or other
  misc_feature (390)..(390): n is a, c, g, or t
tcagtgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcacgccccctcggtgtctgtcgccccaggacagacggccagcattacgtgtggggatacaacgtttcgcccaanaaaactgtacattggtatcancagagcgaggcacggccctgagatggtcgtctgtagacggagtacgggaccggtcccgtcggggactcgtggagtctagttcgttatcggctaccgagttcgtaggaactcgccactcgtacgacctaancgaacggtcgggtacgacgggcgggacggaggaccgacgttatactttgactaacgttcgtagggtaatcggttacgtgggtttacggacgttacggtggggttcggtcgggcgggtaaccggggaccgtaaacggccgttcggtaccgtaaccgttcgggtaaccgtaacgacccgtacggtccgtccggtaccccgtcggtaccctaccgttcttacccgttccccaacccggtttccctaacgtacccttaccctcgtaacccg

SEQ ID NO: 273023 - DNA, 792 bp, Homo sapiens
  misc_feature: GYAE6OF02GEBR9.43.45.E01.1.454.CMB.1.raw
tcagtgtgagtagtcacgaccggtgctcgatttagtgagtcagtaagggaaaggggctgggcctgaggaagcagcactggtggtgcctcagccatggcctggaccgttctcctccttcggcctcctctctcactgcacaggctccgtgcctcctatgaactgtactcaccgccccccgtcgggtgtccgtgtcggaccccgaggacacggaccggaccgagcctaagtttaccgtgggtagggggtaactaacctaaccgtttcgacccgtaaaagtaaaaattcgttaactagtttacggttaactaccgacgacgaaaggaacggaccgaaccgggccgtaccggtccccgtaggtagtacgttgggtccgttacgtggttaggaccggaagggtaccggggacccgggtcccggtacggggtaacgttccggttacggcggtaccgttgttccgtcgtcggtacccgtacggtaacgtcggtaccgggaacgtcccggtaccgtacgttacgtaccgtacgtaacgtccggaccgggtcccggggtccgggaccggggaccgggggacggtaccggcgtaacttactttagtcggtaactacggtgggtagacggttgttacggtcggttacggtacgtcgggttggtcgggtacgggtacggtaacggacgtgtacgtacggtaccgttcggacgtaccgacgaccgccggtaccgtcccggacccggtctccgtaccgttccgtcccttcccgaccctttcccgacttccggtacctacgtacccgg

SEQ ID NO: 273024 - DNA, 835 bp, Homo sapiens
  misc_feature: GYAE6OF02H9DIE.43.45.E01.1.454.CMB.1.raw
  modified_base (138)..(138): a, c, t, g, unknown or other
  misc_feature (138)..(138): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (421)..(421): a, c, t, g, unknown or other
  misc_feature (421)..(421): n is a, c, g, or t
tcagtgtgagtagtcacgaccggtgctcgatttagtgagtcagtaagggaaaggggctggcctgaggaagcagcactggtggtgcctcagccatcggcctggaccgttctcctcctcggcctcctctctcactgcacnggcctccgtcgacctcctatcgaactgactcgaccgccccctgggtctcgtggtaccggcccgaggacacgacggcctaagcacttaccgtgtagggactacgtaacgtttcgacctaagaaactcgtancgttggaactnacgcagaaggcaaggtccgtacggccctgtagacgttcggtcgtcaggtacgacggtacggttacggacccggtccgtggtaactccgttaggtcgacgtacgtttcgtacgtcggactccgaagttcgtacggggaaaccncggtcctaacgtacgtacgtccggaattccggaacggtcccggggtttacgaccggggggtacccggggtaaccgggaccggaccggtttaaccgttcgggtttaaaccttaggttaacccggtaacgttaccggggtagggtttaaaccgggttcgggttaccggtttaccggggtacggtttaaccccggtttaaggggccgggtttacggggtttccggggaacccggggtacgggtaaaccgtagggttacccgtttaccggaccggtttaccccgggtaggttacccggtaaccgaacccggtaggacccggttcccggtaccccgttacgtttacccggacctttacccggtcccgttaccccgtaacccggtttcccaacccgttccgttaccgaccgttacccggg

SEQ ID NO: 273025 - DNA, 698 bp, Homo sapiens
  misc_feature: GYAE6OF01D50Z9.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactccctgctgctcgtggcctcccagtacttccagatgtgacactaccagatcgacccagtccgccacgccctccctgtctgacgaaggtggtgggaagacaggtacgtccttacccgtttttcggccgggacggtacggtccggccctagttcggaccgtacgtttggttcggccgttggttactcggtcgtaggacgaaccggacgggacctaaccctccctacctaaacctttccgtagtaattacgttacccgttacactccgtcttgttcgcgtacgggttccggggtccctaccgttcggttcaggtcggaccgaacggtctcgtaggacgactagtttacttttctcgttcgtactactcctacgttcggttacctacgtacgttcgtacggaaccggaccgggccgtactaagttcgttaacctttcgttacgtaccaactactatccgtacccttcccctaccccctaattaaccgtttccggacgacggggtaacctaaggttacgaaactactaactaacgtaccgtaacttgggtcgtctacgtaccaaccctattcgttcgttcttaccc

SEQ ID NO: 273026 - DNA, 497 bp, Homo sapiens
  misc_feature: GYAE6OF01AGKR0.43.33.C11.1.454.CMB.1.raw
  modified_base (370)..(370): a, c, t, g, unknown or other
  misc_feature (370)..(370): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (493)..(493): a, c, t, g, unknown or other
  misc_feature (493)..(493): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagtattttcnctcgtcatcactggtctacagtctgacgacggcgcaatgtacttctgtcaacnctatcgcctctccccctanaactttcggcacggggaccaagttcgaacatcaatcgaactgtcggctgcnctac

SEQ ID NO: 273027 - DNA, 526 bp, Homo sapiens
  misc_feature: GYAE6OF01CH94L.43.33.C11.1.454.CMB.1.raw
  modified_base (289)..(289): a, c, t, g, unknown or other
  misc_feature (289)..(289): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (520)..(520): a, c, t, g, unknown or other
  misc_feature (520)..(520): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccggcgagtcggccattgacgactgtttggcctggtatcgcgtgagaccagggcaacctcctcaacttcngatactaccgttcatcgtctgttgcgtacggttcgggtcccctacgtcggttcagtcggcaacggctcgtgagactagtattttcnctcgtctatcactggtctacngtctgtacgacgcgactaatcgtacttctgtacaactactatcgccctcctccccctactacgtttccgacgacgggtactacgttagaactactacaagtcgaactggtacgctagaccactntctacg

SEQ ID NO: 273028 - DNA, 556 bp, Homo sapiens
  misc_feature: GYAE6OF01CMH7E.43.33.C11.1.454.CMB.1.raw
  modified_base (359)..(359): a, c, t, g, unknown or other
  misc_feature (359)..(359): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacctttttgccggcgagtcggcccattgacgactgtttggccggtatcgcgtgagaccagggcaacctcctcaacttctgatataccgttcatcgctgttgcacgttgggtccaccgtggttcagtcgcaacggctctgagacagtattttcnctcgtcatcactgtctacagtctgacgacggcgacaatgtacttctgttcaactactactcgtccctccttacccccctaactacgtttccggtacgaacggggtacctaaacggttacgaaaccacttaccaaacgttaccgaacttcggtcggtaccttcggccctaaccctagtccttcgttccttcgtaaccc

SEQ ID NO: 273029 - DNA, 511 bp, Homo sapiens
  misc_feature: GYAE6OF01E17R4.43.33.C11.1.454.CMB.1.raw
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
  modified_base (506)..(506): a, c, t, g, unknown or other
  misc_feature (506)..(506): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggccattgacgactgtttggcctggtatcgcgtgagaccagggcaacctcctcaacttctgatactaccgttcatcgctgttgcgtacggttcgggtcccaccgtcggttcaggtcggcaacggctctgagacagtattttcnctcgtcatcactggtctacagtctgaccgacggcncaagtgtacttctcgtcaactctatcgtcctcctccccctatacttcggtacgagggacctaagtcaactatacaatcgaactgtcgctgaccactntctcg

SEQ ID NO: 273030 - DNA, 503 bp, Homo sapiens
  misc_feature: GYAE6OF01EK1U2.43.33.C11.1.454.CMB.1.raw
  modified_base (366)..(366): a, c, t, g, unknown or other
  misc_feature (366)..(366): n is a, c, g, or t
  modified_base (421)..(421): a, c, t, g, unknown or other
  misc_feature (421)..(421): n is a, c, g, or t
  modified_base (498)..(498): a, c, t, g, unknown or other
  misc_feature (498)..(498): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgtgcacgttgggtcccactcggttcagtggcaacggctctgagactagtatttttcnctcgtcatcactggtctactagtctgacgacggcgacaatgtacttctgtcaacnctatcgcctctccccctatacttcggacacgggacctagttgaactatacaactcgaactgtcgtctagaccacctntctcg

SEQ ID NO: 273031 - DNA, 491 bp, Homo sapiens
  misc_feature: GYAE6OF01DK7QW.43.33.C11.1.454.CMB.1.raw
  modified_base (366)..(366): a, c, t, g, unknown or other
  misc_feature (366)..(366): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (487)..(487): a, c, t, g, unknown or other
  misc_feature (487)..(487): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacctttttgccgggcgagtcggccattgacgactgtttggcctggtatcgcgtgagaccagggcaaccgtcctcaacttctgatataccgttcatcgctgttgcacgttgggtccactcggttcagtgcaacggctctgagacagtatttttcnctcgtcatcactgtctacagtctgacgacggcncaatgtacttntgtcaanactatcgcctcctcccctataactttcggacaggggaccaagttcgaacatcaatcgaactgtagctgcnctac

SEQ ID NO: 273032 - DNA, 538 bp, Homo sapiens
  misc_feature: GYAE6OF01ACURA.43.33.C11.1.454.CMB.1.raw
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
tcagtgtgagtagtcacgaccggtgctcgatttagagtgagctcgttgggtttgggggcgagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgctacgttgggtccactcggttcagtggcaacggctctgagacagtatttttcnctcgtcatctactgtctacagtctgacgacgcgcaatgtacttctgtcaacnctatcgccctcctcccccttatacgtttccggtacacggggtacctaacggttgaaaccgtacttacgaaacttccgaaaccgttgtacggtccctacgtacccgacctagtcttccgg

SEQ ID NO: 273033 - DNA, 596 bp, Homo sapiens
  misc_feature: GYAE6OF01CKARA.43.33.C11.1.454.CMB.1.raw
  modified_base (290)..(290): a, c, t, g, unknown or other
  misc_feature (290)..(290): n is a, c, g, or t
  modified_base (373)..(373): a, c, t, g, unknown or other
  misc_feature (373)..(373): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgactgtttggcctggtatcgcgtgagaccagggcaacctcctcaacttcngtatactaccgtttcactcgctgttcgctacggttgggtcccacgtcggttcagtggcaacggctctgagactagtattttcncttcgtctatctactgtctacagtctgacggacgcgtacaacgttgtaacttctagtaccaactacttaatcgtcccttccctaccccccttaactaaccgtttccggaccggtaacggggtaccctaaaggttacgaaacctacgttaccgaaaacgttcccggtaaaccgttcggttacggtacccgttagacccctaaccttaacgttccgtttaaccgg

SEQ ID NO: 273034 - DNA, 593 bp, Homo sapiens
  misc_feature: GYAE6OF01DQCKL.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgactgttggcctggtatcgcgtgagaccgagggcaacctcctcaacttctgatactaccgttcatcgcttgttcgctacggttcgggtccctaccgtcggttcaggtcggacaacggctcgtgacgactagttactttttcctcttcgtcacttcacgttcggtactacgtacgtctcggacgacggcactaacgtcgttactttctcgtaccaactacttatccgtacccttacccttaccccccgttaacttaacgtttccggtacgtaaccggggtaacctaacggttacgaaacgtacgtactaaacgttccgaaacgttgtcggtactcgacctaccctgtccgttcg

SEQ ID NO: 273035 - DNA, 503 bp, Homo sapiens
  misc_feature: GYAE6OF01DC46C.43.33.C11.1.454.CMB.1.raw
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (498)..(498): a, c, t, g, unknown or other
  misc_feature (498)..(498): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttgggtcccactcggttcagtggcaacggctctgagacagtatttttcncttcgtcatcactggtctacngtctgacgacggcncaatgttactttctgtcaacactatcgccttcctcccccttataactttcggtcacggggaccaagttgaactatcaatcgaactgcggctgcaccntctcg

SEQ ID NO: 273036 - DNA, 518 bp, Homo sapiens
  misc_feature: GYAE6OF01BT3IG.43.33.C11.1.454.CMB.1.raw
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgtcatcgctgttgcacgttcgggtcccacgtcggttcagtcggcaacggctctgagacagtatttttcncttcgtcatcactggtctacngtctgacgacggcacaatcgttacttctgtccaactactatcgcccttccctaccccctatactttcggcgacggggtaccctaaggtcgaactatcaaatcgaacttggacggactcgccacgtc

SEQ ID NO: 273037 - DNA, 543 bp, Homo sapiens
  misc_feature: GYAE6OF01CY4L4.43.33.C11.1.454.CMB.1.raw
  modified_base (370)..(370): a, c, t, g, unknown or other
  misc_feature (370)..(370): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtcctgcaagtgtgggagacagagtctacctttttgccgggtcgagtcggccattgacgactgtttggcctggtatcgcgtgagaccagggccaacctcctcaacttctagatactaccgttcatcgctgttgctacgttggggtcccacgttcggttcagtggcaacggctctgagacagtattttcnctcgtcatcactggtctacagtctgacgacggcgcaatgtacttctgtacaacactatcgcccttcctacccccctactaacgtttccggtacgaggggaaccctaagttacgaaactataccgtaaactcgaaactggtacggcttcggaccaccattctgttccgtttacc

SEQ ID NO: 273038 - DNA, 510 bp, Homo sapiens
  misc_feature: GYAE6OF01BIG4D.43.33.C11.1.454.CMB.1.raw
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
  modified_base (505)..(505): a, c, t, g, unknown or other
  misc_feature (505)..(505): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacgtcggttcagtggcaacggctctgagacagtatttttcnctcgtcatcactggtctacngtctgacgacggcgcaatgtacttctgtcaactactatcgcccttctcccccctataactttccggctacggggaaccctaagttcgaacatcaaatcgaactgtaggctgccnctacg

SEQ ID NO: 273039 - DNA, 671 bp, Homo sapiens
  misc_feature: GYAE6OF01EAM2A.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccacgcctccctgtctgcaagtgtgggagacagagtctaccctttttgccgggcgagtcggccagttcgacgtactgttggcctggtatcgcgtgacgaccgagggccaaccctcctacaacttctgatactaccgttcatcgcttgttcgcgtacggttcgggtccctaccgttcggttcaggtcggaccgacggtctcgtgacgtactagttacttttctcgttcgtctacttccgtacgttcggtaccttacgtacgttctacggaaccggtaccggccgtaacgtaacgttcggtttacctttcgttacgttaccaaactaccgttaactcccgtaccccttacccccttaccccccttaacgttaaccggttttcccgggtaccggtaacgggggtaacccttaaacgggttactaaaccgtacgttacccgtaaacgtcccggttaaacgttcggtacggtccttacggaccctaaccgtacttccgttacg

SEQ ID NO: 273040 - DNA, 659 bp, Homo sapiens
  misc_feature: GYAE6OF01BRO5C.43.33.C11.1.454.CMB.1.raw
tcagtgtgagtagtcacgaccggtgctcgatttagagtgagctcgttgggtttggggaagtctctctcagtcaggacacagtcatggacatgaggtccctgctcagctcctggactcctgctgtctctggctcccagtattccagattgttgacatccagatcgacccagtcgccagcctcccgtgtcgtgcaacgtgtggagacgagagtcctacctttttcgccggcgagtccggcctattcgacgtacttgtttcggcctggtactcgcgtgacgaccgtagggcctaaccctccgtacgaacctttccgtagaacttaacgttaccgtttcgaacgttccggtccgttgttcgtaccgttaccggtttcgggtacccctaccgttcgggttacaggttcggaccgtaaacggtctacgttagaacgtacgtacgttacgtttttcgcttcgtactacttccgtacgttcggtactacgtacgttactacgaaccgaacgcgtactaagttcgttacttctacgtacaactactctaccgacccttacccgtacccctaacgttagttcccggacgtaacgggtacctaagttacgaaacgtagtacgaagtacgaacgttgcgacttcgaacctacctattcctcgttcttaccg

SEQ ID NO: 273041 - DNA, 718 bp, Homo sapiens
  misc_feature: GYAE6OF01AUUQL.43.33.C11.1.454.CMB.1.raw
tcagtgtgagtagtcacgaccggtgctcgatttagagtgagctcgttggggtttggggaagtctctctcagtcaggacacagcatggacatgagggtccctgctcagctcctgggactcctgctgctctggcgtcccagattccagatgtgacatccagactgacccagtcgccagcctcctgtctgccaagtgtggagacagagtcaccttttgccggcgtagtcgtcctattgacgtactgtttcggcgttggtatcgcgttcgacgtaccagggacctaaaccgtcctaccgtaactttcgttacgtacttacgtacccggtttctaagttaccggtcgttacgttacggtaccgtaccgggtttacggggtaccccctaaccgttccggttaccgtacggtccggaccgtaaaccggtcgttcgttacggaacggtaccgtacgttaccgtttttcctaccgttaccgttcgtaacttccgtacgttacggttacctacgacgttaccgtacggaaccggtaccggtactaccgtaacgttaccgttaccttacgtacggtaccctaacgtaccttacgtaccggtacccttacccgtacccccgtaactacgtttccgtaccgtacgggtaaccgtacgttacgaaacctacgtaacgtaacgtacgtacgtcgtacggtacctagtaccaccgtatccgttcgtcgttaccc

SEQ ID NO: 273042 - DNA, 601 bp, Homo sapiens
  misc_feature: GYAE6OF01BUEVW.43.33.C11.1.454.CMB.1.raw
  modified_base (590)..(590): a, c, t, g, unknown or other
  misc_feature (590)..(590): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggcccattgacgactgtttggcctggtatcgcgtgagaccagggcaaccgtcctcaacttctgatactaccgttcatcgctgttgctacggttcgggtccctaccgtcggttcaggtcggcgaacggctcgtgacgactagttacttttctcttcgtctacttccacgttggtctactagttcgtacgaccggacggcgactaacgttcgttacctttcgtcgtacctaacgtacttaacttccgacccttcccctaccccccttaataaccgtttccggaccgtaacggggtaacctaaggttacgaactacgtacaacgttccgtaaacgttcggtacggtctacggacctaaccgtnttccgttaccg

SEQ ID NO: 273043 - DNA, 499 bp, Homo sapiens
  misc_feature: GYAE6OF01EURA0.43.33.C11.1.454.CMB.1.raw
  modified_base (366)..(366): a, c, t, g, unknown or other
  misc_feature (366)..(366): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttcnctcgtcatcacttggtctacagtctgacgcggcgacaatgtacttctgtcaacactatcgcctcctccccctatactttcggcacgggacctagttgaacatcaatcgaactgtgctcgcacatctgtcttcc

SEQ ID NO: 273044 - DNA, 531 bp, Homo sapiens
  misc_feature: GYAE6OF01DA4NN.43.33.C11.1.454.CMB.1.raw
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (505)..(505): a, c, t, g, unknown or other
  misc_feature (505)..(505): n is a, c, g, or t
  modified_base (521)..(521): a, c, t, g, unknown or other
  misc_feature (521)..(521): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttnatcgctgttgcacgttgggtcccactcggttcagtggcaacggctctgagacagtatttttcnctcgtcatcactggtctanagtctgacgacggcgcaatgttactttctgtcaacactatcgccctcctccccccttactaacgtttccggtacgacggggtaaccaaaggttgaaactattacaacttcgaacgttggnggtcctacgaccaccnttccgttacg

SEQ ID NO: 273045 - DNA, 500 bp, Homo sapiens
  misc_feature: GYAE6OF01AYT5A.43.33.C11.1.454.CMB.1.raw
tcagtgtgagtagtcacgaccggtgctcgatttagagtgagctcgttgggtttgggggaagtctctctcagtcaggacacagcatggacatgaggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgttggcctggtatcgcgtgagaccagggcaacctcctcaacttctgatataccgttcatcgctgttgcacgttggggtcccacctcggttcagtggcaacggctctgagacagtactttttctcttcgtcatcactggtctacagttctgacgacggcgacaatgtacttctcgtcaacactatcgcccttcctccccctatactttcggtcagggtaccaagtcgaacatcaatcgactgtgctgcacatctgtctc

SEQ ID NO: 273046 - DNA, 503 bp, Homo sapiens
  misc_feature: GYAE6OF01BSRNC.43.33.C11.1.454.CMB.1.raw
  modified_base (367)..(367): a, c, t, g, unknown or other
  misc_feature (367)..(367): n is a, c, g, or t
  modified_base (498)..(498): a, c, t, g, unknown or other
  misc_feature (498)..(498): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggccattgacgactgtttggcctggtatcgcgtgagaccagggcaacctcctcaacttctgatataccgttcatcgctgttgcacgttggggtcccacgtcggttcagtggcaacggctctgagacagtatttttcncttcgtcatcactggtctacagtctgacgcgcgcaatgtaccttctgtcaactactatcgcctcctccccctactaactttcggtcacggggacctaagttgaactatacaatcgaactgtagctgcaccntctcg

SEQ ID NO: 273047 - DNA, 494 bp, Homo sapiens
  misc_feature: GYAE6OF01EHF1S.43.33.C11.1.454.CMB.1.raw
  modified_base (365)..(365): a, c, t, g, unknown or other
  misc_feature (365)..(365): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagtatttttcnctcgtcatcactggtctacagtctgacgacggcgcaatgtacttctgtcaacactatcgcctcctccccctanactttcggtcagggaccaagttnaacatcaatcgaactgtgctgcacatctgtctc

SEQ ID NO: 273048 - DNA, 609 bp, Homo sapiens
  misc_feature: GYAE6OF01BN311.43.33.C11.1.454.CMB.1.raw
  modified_base (198)..(198): a, c, t, g, unknown or other
  misc_feature (198)..(198): n is a, c, g, or t
  modified_base (375)..(375): a, c, t, g, unknown or other
  misc_feature (375)..(375): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtggganacagagtctaccctttttgcggcgagtcggccattgacgactgtttggcctggtatcgcgtgagaccgagggcaacctcctcaacttctgatactaccgttcatcgctgttgcgtacggttcggggtccctaccgtcggttcagtcggcaacggctctagagactagtactttttcnctcgtcatcactgtctacagtctgacgacggcgcaagttcgtactttcgtacgtccaactactaactccgaccctttcccctacccccccttaacttaacgttttcccgggtaccgtaacgggggtaaccctaaacgggtttacgaaacctaagttaccgaaacgttaccggaaacgttcggtacgggtcctacggtaccctaacccgttatttccgttcgtttaccctttacc

SEQ ID NO: 273049 - DNA, 499 bp, Homo sapiens
  misc_feature: GYAE6OF01EN8UZ.43.33.C11.1.454.CMB.1.raw
  modified_base (493)..(493): a, c, t, g, unknown or other
  misc_feature (493)..(493): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttgggtcccaccgtcggttcagtggcaacggctctgagacagtattttctctcgtcatcactggtctacagtctgacgacggcgacaatgtacttctgtcaacactatcgccctcctccccctatactttcggacagggacctagtgaacatcaatcgaactgtcgtctgacaccntctacg

SEQ ID NO: 273050 - DNA, 563 bp, Homo sapiens
  misc_feature: GYAE6OF01ENKCQ.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggcccattgacgactgtttggcctggtatcgcgtgagaccagggcaacctcctcaacttctgatataccgttcatcgctgttgcacggttcgggtccctaccgtcggttcaggtcggcaacggctcgtgacgactagtacttttctcttcgtcatcactgtctacagtctgacgacgcgactaatcgtacttctgtacaactacttactccgaccttcccttaccccccttaataaccgtttccggacgtacggggtaacctaaggttacgaaactacttacaacgttcggaaaccttggtacgggtctacggacctaacctgttccttaccg

SEQ ID NO: 273051 - DNA, 591 bp, Homo sapiens
  misc_feature: GYAE6OF01CTIP3.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtctacctttttgccgggcgagtcggcccattgacgtactgtttggcctggtatcgcgtgagaccgagggccaacctcctcaacttctgatataccgtcatcgctgtgctacggttcgggtccctacgtcggttcagtcggcgaacggctcgtgagactagtactttttctctcgtcacttcacgttggtctacgagtctacgacgacggcgactaagttcgttaccttctacgtacctaactacctatccgcccttccccttaccccctaactacgtttccggtacgtacggggacctaaggttacgaaactactaccgtaaacgttaccgtaacgttcggtacggtcctacgtaccctaacctattacccgttgttccctttacccg

SEQ ID NO: 273052 - DNA, 564 bp, Homo sapiens
  misc_feature: GYAE6OF01EELRT.43.33.C11.1.454.CMB.1.raw
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgctacgttgggtcccacgtcggttcagtggcaacggctctgagacagtattttctctcgtcatcactggtctangtctgacgacggcnctaatgtacttctagtaccaactactatcgaccccttcctaccccccttaataacgttttccggtaccgtaacggggtaaccctaaaggttacgaaacctacgttacctaaacgttccgtaaacgttggtacggtccttagaccctaacctagttccttaccgg

SEQ ID NO: 273053 - DNA, 630 bp, Homo sapiens
  misc_feature: GYAE6OF01B59C1.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggcctggtatcgcgtgagaccgagggcaacctcctcaacttctgactataccgttcatcgctgttgctacggttcgggccctacgtcggtctagtcgacgtaacggctcgtgagactagttattttctctcgtctatctacttggtctacgtagttctacggacgacggccgactaagtcgttacttcgtacgtacaacgtacttagtccgtcccttaccccgttacccccctaattaaccgttttccgggaccgtaacggggtaaccctaaagggtttaccgaaactaacgtttaccgaaacgtttacccggaaacgtttcgggtaccggtaccgtacgtacccgtaaaccctatttacccgttcggttacccttttacccg

SEQ ID NO: 273054 - DNA, 526 bp, Homo sapiens
  misc_feature: GYAE6OF01CLBGH.43.33.C11.1.454.CMB.1.raw
  modified_base (372)..(372): a, c, t, g, unknown or other
  misc_feature (372)..(372): n is a, c, g, or t
  modified_base (519)..(519): a, c, t, g, unknown or other
  misc_feature (519)..(519): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgctacgttcggggtcccaccgtcggttcagtcggcaacggctctgagacagtatttttcncttcgtcatcactggtctactagtctgacgcggcgacaatgtacttctgtacaactctatcgacccttcctaccccctataactttcggacgacggggacctaagttacgaactactacaagtcgaactggtcgtctcgaccacctntcgttcg

SEQ ID NO: 273055 - DNA, 524 bp, Homo sapiens
  misc_feature: GYAE6OF01C8K1R.43.33.C11.1.454.CMB.1.raw
  modified_base (403)..(403): a, c, t, g, unknown or other
  misc_feature (403)..(403): n is a, c, g, or t
  modified_base (495)..(495): a, c, t, g, unknown or other
  misc_feature (495)..(495): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcctacctttttggccgggcgagtccggccattgacgactgtttggcctggtatcgcgtgagaccgagggcaacctcctcaacttctgatataccgttcatcgtctgttcgctacggttcggggtcccacgttcggttcaggtcggacaacggctctgacgacagttattttctcttcgtctatctacgtcggtctacngtctggacgacggcactaatcgtacttctgtacaactactatcgtccctccctacccctatacgtttcgacgacgggactaagttacaactntacaatcgatgngctgcacntctntctac

SEQ ID NO: 273056 - DNA, 562 bp, Homo sapiens
  misc_feature: GYAE6OF01CICLU.43.33.C11.1.454.CMB.1.raw
  modified_base (435)..(435): a, c, t, g, unknown or other
  misc_feature (435)..(435): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggccattgacgactgtttggcctggtatcgcgtgagaccagggccaacctcctcaacttctgatactaccgttcatcgctgttgctacggttcgggtcccaccttcggttcagtcggcaacggctcgtgagactagtatttttctcttcgtcattcctacgttggtactacgtagtctgaccgacggcgtacaatgtacttctntaccaactctatcgtcccttccctacccccctatacgtttccggtacgtacggggtacctaacggttacgaactactacaaactacggaaccttggtcggcttacgacctaccctagttccgttacg

SEQ ID NO: 273057 - DNA, 589 bp, Homo sapiens
  misc_feature: GYAE6OF01BL3HR.43.33.C11.1.454.CMB.1.raw
  modified_base (410)..(410): a, c, t, g, unknown or other
  misc_feature (410)..(410): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgactgtttggcctggtatcgcgtgagaccgagggcaaccctccgtcaacttctgatactaccgttcatcgtcttgttgcgtacggttcggggtcccaccgttcggttcaggttcggcaacggtctcgtgagtactgtacttttctcttcgtctactcacttggtactacngttctgacgacggcacaatcgtacttctgtaccaactactactcgcccttcccttacccccttaacttaacgtttcccggaccgtaacgggggtaacccttaaaggttacgtaaacctacttaccaaagtccgtaaacgtggtcggtaccttacggaccctacctacgttccgttaccg

SEQ ID NO: 273058 - DNA, 581 bp, Homo sapiens
  misc_feature: GYAE6OF01EL42N.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccagttgacgactgtttggcctggtatcgcgtgagaccagggcaacctctcaacttctgatataccgttcatcgtcttgttgcgtacgttggggtccccaccgtcggttcagtcgggcaacggctctgagactagtattttcgtctcgtacatcactcggtctacgagttcctgaaccggacggccgactaatgttaccttcgtacgtacaactactactcgtcccctccctccccctaataacgtttccggacgtaacggggtaacctaagttacgaaactaactacgtaaacgtacgaaacttcggtaggtcctacgtacccaaccgtattccgttgttccgttaccg

SEQ ID NO: 273059 - DNA, 586 bp, Homo sapiens
  misc_feature: GYAE6OF01CX8AB.43.33.C11.1.454.CMB.1.raw
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
  modified_base (398)..(398): a, c, t, g, unknown or other
  misc_feature (398)..(398): n is a, c, g, or t
tcagtgtgagtagtcacgaccggtgctcgatttagagtgagctcgttgggtttgggggcagaagtctctctcagtcaggacacagcatggacatgaggtccctgctcagctcctgggactcctgctgctctggtctcccagattccagatgtgacatccagatgacccagtcgccagccgtcctgtctgcaagtgtggganacagagtctaccctttttgccgggcgacgtcggccctagttggacgtactgtttacggccttggtatcgcgtgagaccagggccaacctcctcaacttctaggatagtaccgtttnactcgacttgttgctacgttcggggtccccacgttcggttcagtcggacaacggtctcgtagacgtacagtacgtttttcncttcgtcatccacttggtctacacgtctagacgacgcgtctaatcgtacctttctcgtaccaactactacgtcgacccttcctcccccgtaataactttccggtacacggggtaacccaaaggtttacgaactagtcctaaatccggtaaacttcggttcggtcttacgccaaccctattccgttacg

SEQ ID NO: 273060 - DNA, 525 bp, Homo sapiens
  misc_feature: GYAE6OF01AV4ZI.43.33.C11.1.454.CMB.1.raw
  modified_base (411)..(411): a, c, t, g, unknown or other
  misc_feature (411)..(411): n is a, c, g, or t
tcagtgtgagtagtcacgaccggtgctcgatttagagtgagctcgttgggtttgggggcgagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccaggggcaacctcctcaacttctgatataccgttcatcgctgttgctacgttcgggtcccaccgttcggttcagtggcaacggctctgagacagtacttttctctctcatcactggtactacagtctgacgacggcncaatgtacttctgtccaactctatcgccctcctcccccctactaacgtttccggtacgagggtaccctaaggttcgaactatccaatccgaacctgtcggactcgccacgtacg

SEQ ID NO: 273061 - DNA, 607 bp, Homo sapiens
  misc_feature: GYAE6OF01DTCFX.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgacttgttggcctggtatcgcgtgagacgagggcaacctcctcaacttctgtatactaccgttcactcgcttgttcgcgtacggttcgggtccctacgttcggttcaggtcggacaacggtctcgtagagtactagttactttttctctcgtctatcctacgtggttcctaacgtgttccgtaggaccggtaccgggcgtactaagttcgttaacctttcgttacgtaccaactacttactccgtaccctcccttacccccttaatacgtttccggtacgacgggtaacctaaggttacgaaactactacgtaacgttaccgaacgttcggtacgtctacggacctacctattccgttgttcccttaccg

SEQ ID NO: 273062 - DNA, 635 bp, Homo sapiens
  misc_feature: GYAE6OF01CTPPI.43.33.C11.1.454.CMB.1.raw
  modified_base (381)..(381): a, c, t, g, unknown or other
  misc_feature (381)..(381): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccgtttttgccggcgagtcggcctatgacgactgtttggcctggtatcgcgtgacgaccgaggcaacctctactaacttctgatactaccgttcatcgcttgtcgctacggttcgggtcccacgttcggtcaggtcgacgaacggctcgtgacgtactagttatttttcncttcgtctactctacgtggttactacgtagttctacggaccgaccgggaccgtactaaagttcgtttacctttcgtacgtacctaaacgtaaccttaactccgtccccttacccttacccccccttaacttaacgttttccgggtaaccgtaaccgggggtaaaccctaaggtttaccgaaacgtacgttaacctaaacgtaccgtaaaccgttcggttacggtccttacgacctaaccctgttccgtttaccg

SEQ ID NO: 273063 - DNA, 879 bp, Homo sapiens
  misc_feature: GYAE6OF01DAZDJ.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccacgcctccctgtctgcaaggtgtgggagacagtagttccttaccgtttttggccgggcgagtccggccattgacgtacgttgtttcggccgttggtactcggcgtggacgaccgacgggaccaaccttcctacctaacttctagtaacttacttacccgttcaacttcgtcgttgttcgccgtaccgggttccggggtcccctaccgttcggttacctacggttcggaccgtaacggtcctacgtacgacgtaacgtacgtttacgtttttccgtccgttacgtactacgtttaccgtaccgtttcgggtaccttaaccggtacggtttaccgttaaccgggaaccgggtacccgggtaccgtaaccgtttaaacggtttccggtttaacccgtttcccgtttaacggttaaacccgtaaaccctttaaccgtttaacccgtttaccccggttaccccccttttaacccccccgtttaaccccccccctttaaaacggttttaaccccgggtttttaacccggggtaaccccgggtaaaaccgggggggtttaaacccctttaaaagggtttaaaccccgggaaaaccttaacggttaaacccgttaaaaccggtttaaccccgttaaaccggttcggggttaccggtaccgttaaccggtaccctaacccgttaacttcccgtttaccggtttcctttaacccccg

SEQ ID NO: 273064 - DNA, 710 bp, Homo sapiens
  misc_feature: GYAE6OF01DMTEA.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctggactcctgctgctctggcctcccagcagattccagatgtgacatccagatcgacccagtcgccacgcctccctgtctgcaagtgtgggagacagtacgttccttacccgtttttcggccgggcggtacgtccggccctaagttcgacgtacgttcggtttcggccgttggtactcgcgtgacgaccgaggccaaccgtcctactaactttctacgtactacttaccgttcactcgcttgttcgcgtacggttcggtacccctaccggttcgttcgacggtcggaccgaaccggtctacgtcgaaggtaactacgtttactttttcctacttccgtactacgtcctacgttcggttacacgtacgttccgtacggaaccggtaccggaccgtacgttaacgtttcgtttaacctttctaccggtaacctaaccgttacctacgttccccgtaccccttaccccttaccccccttaacgtttaccgtttaccgggaccgtaccgggtaaacccgttaacggttacgtaaaccttacgttaaccgaaacgttaccggtaaacgttccgtacggtccttacgtacccgtacgttaccg

SEQ ID NO: 273065 - DNA, 497 bp, Homo sapiens
  misc_feature: GYAE6OF01B6G59.43.33.C11.1.454.CMB.1.raw
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
  modified_base (489)..(489): a, c, t, g, unknown or other
  misc_feature (489)..(489): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccactcggttcagtgcaacggctctgagactagatttttcnctcgtcatcactggtctacngtctgacgacggcgcaatgtacttctgtcaacactatcgcctcctccccccttatactttcggtacgacgggaccaagttcgaacatcaatcgactgtgctgcacntctgtctc

SEQ ID NO: 273066 - DNA, 570 bp, Homo sapiens
  misc_feature: GYAE6OF01BKHLM.43.33.C11.1.454.CMB.1.raw
  modified_base (369)..(369): a, c, t, g, unknown or other
  misc_feature (369)..(369): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctcctgtctgcaagtgtggagacagagtctaccctttttgccgggcgagtcggccattgacgactgtttggcctggtatcgcgtgagaccagggcaacctcctcaacttctgatactaccgttcatcgctgttgctacggttcgggtcccaccgtcggttcagtcggcaacggctctagagactagtattttcnctcgtcatcactggtctacagtctgacgacggcgactaatcgttaacttctgtacaactactactcgacccttccctaccccccttaataaccgttttccggtaccgtacgggtaaccctaagtttacgaaacctagttaccaaacgttaccgtaaacttggtacgtactacgtaccactaattccttgttccttaacccg

SEQ ID NO: 273067 - DNA, 493 bp, Homo sapiens
  misc_feature: GYAE6OF01B9S7J.43.33.C11.1.454.CMB.1.raw
  modified_base (437)..(437): a, c, t, g, unknown or other
  misc_feature (437)..(437): n is a, c, g, or t
  modified_base (465)..(465): a, c, t, g, unknown or other
  misc_feature (465)..(465): n is a, c, g, or t
  modified_base (488)..(488): a, c, t, g, unknown or other
  misc_feature (488)..(488): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttgggtcccactcggttcagtggcaacggctctgagacagtattttctctcgtcatcactggtctacagtctgacgacgcgcaatgtacttctgtcaactactatcgcctctccccctanactttcggtcacgggaccaagtgaactntacaatcgactgtcgtctgcacntctcg

SEQ ID NO: 273068 - DNA, 529 bp, Homo sapiens
  misc_feature: GYAE6OF01DGN77.43.33.C11.1.454.CMB.1.raw
  modified_base (363)..(363): a, c, t, g, unknown or other
  misc_feature (363)..(363): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttcgggtcccaccgtcggttcagtgcacggctctgagacagtattttcnctcgtcatcactggtctacacgtctgacgacggcgcaatgtacttctcgtactaacactatcgtccctccctccccctactaacgtttccggtacacggggtaaccaagttcgaacctagtacgaatcgtaactggtacggctacgccaccattcttgttcttacc

SEQ ID NO: 273069 - DNA, 762 bp, Homo sapiens
  misc_feature: GYAE6OF01D7AOU.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtctacccgtttttggccgggcgagtccggccctagttgacgactgttcggcctggtatcggcgtgagaccgagggcctaaccctcctactaacttctacgaacttactaccgttctacgttcgtcttggttcgtacgtaccgggtttccgggtaccccgtacccgttcggttacgacgggtcggtacgtaaccggtcgtacgtagtacgtaacgtaggttacctttttcgtaccgttccgtaccttacgttacccgtaacgtttcggtaacctttacgtacgttacccgttacggtaacccggtaccgggtaccgtaccgttaacgtttcgttaaccgttttcccgttaacgttaccgtaaaccttacgttaaccgttcccgtacccccttacccccttaacccccccgttaagttaacccgttttaccggtaaccggtaaccgggtaacccgttaaaggttaaccgtaaaccgtacgttaacgtaaaccgttaccggaaaccgtttcgggtaccggttactaccgtaacccgtaccgttacgttcgtttacccgg

SEQ ID NO: 273070 - DNA, 617 bp, Homo sapiens
  misc_feature: GYAE6OF01A463H.43.33.C11.1.454.CMB.1.raw
tcagtgtgagtagtcacgaccggtgctcgatttagagtgagctcgttgggtttgggggcgagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggtcgagtccggccattgacgactgtttggcctggtatcgcgtgagaccgaggcaaccgtcctcaacttctgactacttaccgtcactcgtctgttgcgtacgtttcgggtcccctaccgttccgggttcacggtggccgaaaccggtctactgacgtacaggttacttttcgttctcggtctacttctattcggtactactacgtctacgacgcggaccgctaacgtgttacttcgtgtacctaactactaacttcgtcccttacccttaccccccttaacttaaccttccggtaaccgtacggggaaccttaaacggttacgaacgttactactaacgttaccgtaacgttcggtcgtaccgtacgacgaccccgttatcccgtttaccgg

SEQ ID NO: 273071 - DNA, 906 bp, Homo sapiens
  misc_feature: GYAE6OF01B2LAB.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtccgccacgccctccctgtctgcaaggtggtgggagacagtacgtccttacccgtttttcggccgggcggtacggtccggccctagttcgacgtacgttcggtttcggtccgttggttacgtccggtcggtacggacggaccgaacggggtacctaaaccccttcccgtacctaaaccgtttccgtacggtaacttaacgttaacccgtttacctaacgttccgtcgttaaaaacggtttcggtaccggttaccgggtttccgggggttaccccgtacccggtttccgggtttacgtacgggttacgggtaccggtaaaccgggtccgttccgtaacggtaacggtaacgttaacgtttacgttttttccgttaccgttaccgttacgtaacgttaccgttaccggtttacggtttaaccgttaaccgtaacggttaccggttacgggtaaccgggtaaccgggtaccggtaccgtaacgtttaccgttaccgtttaccgttacgttaacctaacgtaaccgttacgttacccgtaccccttaccccttaaccccccgtttaaacccgttaaccggttttacccgggttaaccgggtaaccggggtaaacccgttaaacggtttaaccgtaaaccgttaacgtaaccgttaaaccgttaaccggtaacggttccggttacggtaccgttaccggtacccgtaacccgttaacgttccgttcgtttacccgtttacccg

SEQ ID NO: 273072 - DNA, 586 bp, Homo sapiens
  misc_feature: GYAE6OF01COQDN.43.33.C11.1.454.CMB.1.raw
  modified_base (397)..(397): a, c, t, g, unknown or other
  misc_feature (397)..(397): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtctacctttttgccgggcgagtccggcctattcgacgtacttgtttcggccttggtatcgcgtgagaccgagggcaacctcctctaacttctgatactaccgttcactcgtctgttcgcgtaccggttcgggtccctaccgtcggttcgaggtcggcgaacggctcgtagacgactagttattttcncgtcgtctatcacgttgtactacgtagtcgtagaccgacggcgactaagttcgttacttctgtaccaacgtactactccgtcccttccctaccccttataacgtttccggacgaacggggtaacctaaggttacgaaactactactaacgttaccgaacgttggtacggtctacggcctaaccgttacg

SEQ ID NO: 273073 - DNA, 565 bp, Homo sapiens
  misc_feature: GYAE6OF01ASCGE.43.33.C11.1.454.CMB.1.raw
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggccattgacgactgtttggcctggtatcgcgtgagaccagggcaaccctcctcaacttctgatataccgttcatcgctgttgcacgttgggtcccacctcggttcagtcgcaacggctctgagacagtattttcnctcgtctatcactgtctactgtctgacgacgcgctaatgtaccttntcgtacaacacttatcgtcccttccctaccccctaacgtaacttttccggaccgtaacggggaccctaaagttacggaaactacgttaccaacgttacccggtaacttacggttacggtacctacggaccctaaccctagttcccgttacgg

SEQ ID NO: 273074 - DNA, 563 bp, Homo sapiens
  misc_feature: GYAE6OF01AYXOQ.43.33.C11.1.454.CMB.1.raw
  modified_base (290)..(290): a, c, t, g, unknown or other
  misc_feature (290)..(290): n is a, c, g, or t
  modified_base (393)..(393): a, c, t, g, unknown or other
  misc_feature (393)..(393): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgttggcctggtatcgcgtgagaccagggcaacctcctcaacttcngatataccgttcatcgctgttcgctacggttcggggtcccacgttcggttcagttcggcaacggctctgagacagtattttctctcgtcatcactggtctacngtctgacgacggcgcaatcgtacttctgtacaacgtactaatcgccttcctacccccttataacgtttccggtacgaacggggtaccctaaagttacggaaacctacgtaccaaacgttccgaaacgttacggtcggtaccgttacgacccaacctacgttcgtttaccg

SEQ ID NO: 273075 - DNA, 529 bp, Homo sapiens
  misc_feature: GYAE6OF01BBDW5.43.33.C11.1.454.CMB.1.raw
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
  modified_base (519)..(519): a, c, t, g, unknown or other
  misc_feature (519)..(519): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccagttgacgactgtttggcctggtatcgcgtgagaccagggcaacctcctcaacttctgatactaccgttcatcgcttgttcgctacgttggggtccctaccgtcggttcaggtggaccaacggctcgtagagactagtatttttcncttcgtctatcactggtcctacagtctggacgacggcanaattgtacttctgtcaacactatcgcccttcctaccccctaatacgttcgacgacgggacctaagtcgaacataccgaattcgaacgtgcgctcgccactntctgtctacc

SEQ ID NO: 273076 - DNA, 686 bp, Homo sapiens
  misc_feature: GYAE6OF01D6DH9.43.33.C11.1.454.CMB.1.raw
  modified_base (401)..(401): a, c, t, g, unknown or other
  misc_feature (401)..(401): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctcctgtctgcaagtgtgggagacagagttctaccctttttggccggcgagtcggcccattgacgtactgtttcggcctggtatcgcgtgacgaccgagggccaacccgtcctacaactttctagtatactaccgttcatcgctgttcgcgtacggttcgggtccctaccgtcggttcaggtcggacctaacggctcgtagacgacctagttaacttttttcnccgttccgtctaacttaccgtacgtttacggtacccttaacgtacgttaccgtacggacccggtaccgggtcgtaacctaaacgttcgttaccgtttacttacggttacaaacctacgttacttcgtccccttccccttaccccccgttaacttaacggtttccggtaaccgaacggggttaaccctaaacggtttacgaaaccgttaacgtacctaaacgttcccggaaaacgttcgggttaccggtacttaccggtaccctacccgtaagttcccgtttaccg

SEQ ID NO: 273077 - DNA, 557 bp, Homo sapiens
  misc_feature: GYAE6OF01AT29B.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgactataccgttcactcgctgttgctacgttcggggtcccacgtcggttcaggtcggcaacggtctcgtgagactagtactttttctctcgtcactctactggtctacacgtctgaccgacggcgacaatgtacttcgtacgtcaactactatcgccctcccttaccccccttagtaaccgtttccggtaccgacggggtaaccctaacgttacgaacacttacgaactccgaacgtggtcggtctcgacctaccctgttccttcg

SEQ ID NO: 273078 - DNA, 552 bp, Homo sapiens
  misc_feature: GYAE6OF01CH3WZ.43.33.C11.1.454.CMB.1.raw
  modified_base (380)..(380): a, c, t, g, unknown or other
  misc_feature (380)..(380): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggcccattgacgactgtttggcctggtatcgcgtgagaccgagggccaacctcctcaactttctgatactaccgttcatcgcttgttcgctacggttcggggtccctacgttcggttcaggtggcaacggtctctgagactagttatttttcncttcgtcatcacttgtctactagtctgacgacggcgactaagttcgttacttcgtacgtacaactactatccgtccttccctaccccctatacgtttcggtacgacgggtaacctaagttacgaaactatacgtaacgtacgactgtcgctagaccactatcttgtcttacc

SEQ ID NO: 273079 - DNA, 573 bp, Homo sapiens
  misc_feature: GYAE6OF01B2XP5.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtctacctttttgccgggcgagtcggcctattgacgtactgttggcctggtactcgcgtgacgacagggccaacctcctactaacttctagtactactaccgttcactcgtctgttgctacggttcgggtccctacgtcggttcagtcggacaacggctcgtgacgactagtattttctctcgtctatcactgtctacacgttctacgacgacggcactaagtcgtacttctcgtacaactactactcgcccttcctacccctactacgtttccggacgtacgggtaacctaaggttacgaaactacgtaactaacgtacgtaacgttcggtcggtactcgtacctaacctacgttctcgttcctttaccg

SEQ ID NO: 273080 - DNA, 556 bp, Homo sapiens
  misc_feature: GYAE6OF01A0URH.43.33.C11.1.454.CMB.1.raw
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccggcgagtcgccattgacgactgttggcctggtatcgcgtgagaccagggccacctcctcaacttctagatataccgttcatcgctgttgcgtacggttcgggtccctaccgttccggttcaggtcggccgaacgggtctcgtgagacgtagttactttttctcttccgttctacttcctacgttcggttctaacgtagttcgtaggaccggacggtccgacctaagttcgttacctttctagtacaaccgtactactcgtccctccctaccccctacttacgtttcgacgacgggacctagtacacatacaatcgagtcgngctncactatctgtctc

SEQ ID NO: 273081 - DNA, 494 bp, Homo sapiens
  misc_feature: GYAE6OF01BC22Y.43.33.C11.1.454.CMB.1.raw
  modified_base (364)..(364): a, c, t, g, unknown or other
  misc_feature (364)..(364): n is a, c, g, or t
  modified_base (417)..(417): a, c, t, g, unknown or other
  misc_feature (417)..(417): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggccattgacgactgtttggcctggtatcgcgtgagaccagggcaacctcctcaacttctgatataccgttcatcgctgttgcacgttgggtcccacctcggttcagtggcaacggctctgagacagtatttttcnctcgtcatcactggtctacagtctgacgacggcgcaatgtacttctgtcaacnctatcgccctcctccccctanactttcggtcagggacctaagtnaacntcaatcgactgngcngccacatctgtctc

SEQ ID NO: 273082 - DNA, 682 bp, Homo sapiens
  misc_feature: GYAE6OF01AR5B4.43.33.C11.1.454.CMB.1.raw
tcagtgtgagtagtcacgaccggtgctcgatttagagtgagctcgttgggtttggggaagtacgtctactcacgtcaggacacacgcatggacatgacggtccctgctcaggctcctgggactcctgtctgctctggctccagattccgagactgtcgacatccaggatcgacccagtcgccacgccctccctgtctgacaagtgtggggacacagtagtcttacccgttttttggccgggtcgacgtccggccctagttcgacgtacttgtttcggcctggtactcgcgtgaggaccagggcaacccgtccgtacgaacgtttcgtgtatacttaccgttcaagttccgacttgttcgcgtaaccggtttcgggtacccaccgttcggttacaggtcggacgtaacggtctcgtagagacgtacgttatttttccgtacgttccgtaccgacttaccgacgttacggttacctaaccgtacgttccgttacggaccggaacggtccgtactaagttcgttacgttcgtcgtacaactactgtccgtaccctacccgtacccccttagttacgtttaccggtacgtaccgggtacctaaggttacgaaacctacgttacgtaacgtccgtaaacgttcggtacgtctacgtacctaccgtagttcgttccgttcgttacccg

SEQ ID NO: 273083 - DNA, 565 bp, Homo sapiens
  misc_feature: GYAE6OF01CF82E.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgtactgtttggcctggtatcgcgtgagaccagggcaacctctcaacttctgatataccgtttcatcgctgttcgcgtacgttcggggtcccaccgttcggttcaggtcggcctaacggctcgtgagacgtagtattttctctcgtcatcactgtctacagtctgacgcgcgactaattcgtacttctgtaccaacgtactactcgtcccttacccttacccccctaattaaccgtttccggtaccgaacggggtaccctaaaggtttacgaactactacgaaactcgtaacgttggtacgtctcgacccacctagttcgttaccg

SEQ ID NO: 273084 - DNA, 500 bp, Homo sapiens
  misc_feature: GYAE6OF01DYMU6.43.33.C11.1.454.CMB.1.raw
  modified_base (366)..(366): a, c, t, g, unknown or other
  misc_feature (366)..(366): n is a, c, g, or t
  modified_base (398)..(398): a, c, t, g, unknown or other
  misc_feature (398)..(398): n is a, c, g, or t
  modified_base (495)..(495): a, c, t, g, unknown or other
  misc_feature (495)..(495): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttgggtcccactcggttcagtggcaacggctctgagacagtatttttcnctcgtcatcactgtctacagtctgacgacgcncaatgtacttctgtacaacactatcgcctcctccccctacaactttcggtacagggaccaaggttgaactatacaatccgaactgtcgctagccacntctcg

SEQ ID NO: 273085 - DNA, 654 bp, Homo sapiens
  misc_feature: GYAE6OF01BJ2AC.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtctacccgtttttggccgggcgacgtccggcctattgacgacttgtttggccgtggtatcgcgtgacgaccgagggcctaacctcctccaaccttctagtactactaccgttcatcgcttgttcgctacggttcggtccctacgtcggttcaggtcggacgtaacggtctcgtgagtacgtagttacttttcgtcttcgtactactctacgttcggtactaacgtagttcgtacgtaccggacggccgtactaagttcgttaacttcgtacgtacctaaactaccgttactcccgtacccttccccttaccccccttacgttaaaccgttttccgggtaaccggtaacgggggtaaacccttaacgggttaaccgaaacgttaccgttacctaaacgttaccgtaaacgttcggtacggtacctacggtacctaacccgttacg

SEQ ID NO: 273086 - DNA, 569 bp, Homo sapiens
  misc_feature: GYAE6OF01AJ9VA.43.33.C11.1.454.CMB.1.raw
  modified_base (396)..(396): a, c, t, g, unknown or other
  misc_feature (396)..(396): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttggccgggtcgagtcggcccattgacgactgtttggcctggtatcgcgtgagaccagggcaaccctcctcaacttctgatataccgttcatcgctgttgctacgttcgggtcccacgtcggttcagtggcaacggctcgtagagactagtattttctcgtcgtcatcacgtgtctacngtctgacgacggcactaatgtacttctgtaccaaccgtctatcgtacccttaccctccccccttaataaccgtttccggaccgtacgggggtaccctaaaggttacgaacctaactactaaacgtccgaaaccgttggtacggtacctcgtaccaacctacgttccgttaccg

SEQ ID NO: 273087 - DNA, 697 bp, Homo sapiens
  misc_feature: GYAE6OF01DGF4S.43.33.C11.1.454.CMB.1.raw
  modified_base (421)..(421): a, c, t, g, unknown or other
  misc_feature (421)..(421): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatcgacccagtcgccacgccctccctgtctgcaagtgtgggagacagtacgtccttacccgtttttggccgggtcgtacgtccggcctagttacgacgtacttgtttcggccttggtatcgcgtgacgaccgaggccaacctcctactaacttctagtatactaccgttcactcgtcttgttcgccgtacggttcgggtccctacgttcggttacaggtcgaccgtaacggtctacgtagacgtactagttactttttcncgttcgtctatcctacgttcggtactacgtagtacgtagaccgacggtacgtactaaagttcggttacctttcgtacgtaaccctaacttaccgttaacgtcccgtacccctttaccccttaacccccctttaagtttaacccggttttccgggtaaccgggtaaaccggggttaaccctaaaggttaaccgtaaaacttacgttaaccaaacggttaaccgttaaccggttggtaccggtacccttacggaccctaacgttacgttccgttaccg

SEQ ID NO: 273088 - DNA, 622 bp, Homo sapiens
  misc_feature: GYAE6OF01CPPFL.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatcgacccagtcgccacgcctcctgtctgcagtgtggggacagagtctaccgtttttgccggcgtagtcggcccagttgacgtacgtgttcggtccgtggtatcggcgtgacgaccgacgggacctaaccgtcctactaacttctagtacttacgtaccgttctatccgtacgttgttcgcgtacggtttccggggtcccctaccgttcggttcgaggtcggaccgaacggcttacgtgagtacgtacgtttattttcctctcgtctactcctacgttcggttactacgtacgtcgtacggaccggtaccggtcgactaacgttcgttaactttcgtacgtactaactactacgtccgtcccttcccttaccccctacgttacgttcggtaccgtacgggtaccgtagtacgactatacaacgtcgtaacgtcggtacgtacgtcacctactgttccg

SEQ ID NO: 273089 - DNA, 542 bp, Homo sapiens
  misc_feature: GYAE6OF01E0A66.43.33.C11.1.454.CMB.1.raw
  modified_base (353)..(353): a, c, t, g, unknown or other
  misc_feature (353)..(353): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgttggcctggtatcgcgtgagaccagggcaacctcctcaacttctgatactaccgttcatcgctgttgctacggttgggtccctacgtcggttcagtggctaacggctcgngagactagtatttttctctcgtctatcactggtctacagtctgaccgacggcgcaatcgtacttctgtcaactactatcgccctccctccccctaatactttcggtaccgagggtacctaagttacgaacgaattaccgaaattccggtaactgtacggtcctaggtaccacctattctgtccttaccg

SEQ ID NO: 273090 - DNA, 533 bp, Homo sapiens
  misc_feature: GYAE6OF01AZEW0.43.33.C11.1.454.CMB.1.raw
  modified_base (395)..(395): a, c, t, g, unknown or other
  misc_feature (395)..(395): n is a, c, g, or t
  modified_base (436)..(436): a, c, t, g, unknown or other
  misc_feature (436)..(436): n is a, c, g, or t
  modified_base (507)..(507): a, c, t, g, unknown or other
  misc_feature (507)..(507): n is a, c, g, or t
  modified_base (533)..(533): a, c, t, g, unknown or other
  misc_feature (533)..(533): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagccctccctgtctgcaagtgtgggagacagagtcctacctttttgccgggcgagtcggccattgacgactgttggcctggtatcgcgtgagaccgacgggccaaccgtcctactaacctttcgtagtatactaccgttcactcgtcttgttgcctacggttcgggtccccacgttcggtcagtggcgaacggtctcgtgacgactagtatttttcncttcgtctatcacgttgtactactagtctgacgtacggcgntaatgttacttcgtagtaccaactactatccgtccttccctcccctatacttcggacgacgggactaagtnacatcaatcgaactgtcgctgcactn

SEQ ID NO: 273091 - DNA, 650 bp, Homo sapiens
  misc_feature: GYAE6OF01BY2N4.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagccctcctgtctgcaagtgtgggagacagagtctacccgtttttggccgggcgagtccggccattgacgtacttgtttcggccttggtatcgcgtgacgaccgagggccaaccgttcctactaaccttcgtagtatacttaccgttcactcgtcttgttgccgtacggttccgggtacccctacggttcggttcgaggttcggaccgaacggtcttcgtagacgtactagttactttttctcttcgttctactctacttggtactacgtagtcgtacggaccgacggtcacttaagtcgttaccttcgttacgtacctaacgtacttacgtccgtaccccttcccctttacccccctagttaccggtttccggtacgtaacggggtaaccctaaggttacgaaccgttaacttaccaaacgtttaccggaaaccgtttcgggtacggtcccttacggaccctacgttaccg

SEQ ID NO: 273092 - DNA, 557 bp, Homo sapiens
  misc_feature: GYAE6OF01EQM0P.43.33.C11.1.454.CMB.1.raw
  modified_base (379)..(379): a, c, t, g, unknown or other
  misc_feature (379)..(379): n is a, c, g, or t
  modified_base (550)..(550): a, c, t, g, unknown or other
  misc_feature (550)..(550): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggccattgacgactgttggcctggtatcgcgtgagaccagggcaaccctcctcaacttctgatataccgttcatcgcttgttgctacggttcgggtccctaccgtcggttcaggtggacaacggtctctggacgactagtatttttcnctcgttcattccacttggtactacacgttctagaccggacggcgacaattgttaccttctcgtaccaactacttactcgtccccttacccttacccccctatacgtttccggtccgacgggtaacctaagttacgaactactacaatcgaactggtacgtctacacacctntcgttcg

SEQ ID NO: 273093 - DNA, 543 bp, Homo sapiens
  misc_feature: GYAE6OF01AO46K.43.33.C11.1.454.CMB.1.raw
  modified_base (378)..(378): a, c, t, g, unknown or other
  misc_feature (378)..(378): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctcctgtctgcaagtgtcgggagacagagtctacccgtttttgccgggcgtagtcggcccattcgacgtactgtttggcctggtatcgcgtgagaccgaggcaacctcctcaacttctgatactaccgttcactcgctgtcgctacggttcgggtccctacgtcgttcagtcgacgacgctctgagactagtacttttcnctcgtctactctacgtgtctacgtgtcgtacgacgacggcgtactaacgtcgtacttctcgtacaactctatcgtcctcctaccccgtatacgttcgtacgacgggtactagttacgaactactactagtaccgtatacgtcgtactacaccgacctgtcgtacg

SEQ ID NO: 273094 - DNA, 694 bp, Homo sapiens
  misc_feature: GYAE6OF01DTG9W.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcctacctttttgccgggcgacgtcggccattgacgacttgttcggctggtactcgcgtgacgaccgagggcaacctcctctaactttctagtatacttaccgttcacgtccgcttgttcgcgtacggttccggggtcccctaccgttcggttcaggtcggaccgaacggtcttcgtacggacgactagttactttttcctcttcgtactactcctacgttcggtaccttacgtaacgttcgtaggaaccggacggcccgacgtaagttcgttacctttctacgtaacctaacctaccttactccgtccccttacccccgttaccccccgttaacgttaaccgttttccggtaaccggtaaccggggtaacccttaaacgggttacgaaaaccgtacttaaaccgtaaacgttaacccgtaacggttcggtacgggtacctaccggtaccctaaaccgttactttacccgttcgtttcccgtttaacccg

SEQ ID NO: 273095 - DNA, 707 bp, Homo sapiens
  misc_feature: GYAE6OF01DZN17.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtcgccacgccctccctgtctgcaagtggtgggagacagtacgtcctacccgttttttcggccgggtcgacggtccggccctagttcgacgtacgttggtttcggccttggtactcgcggttgacgaccgacgggaccaacctccgtactaacctttctagtacttacgttaccgttctaacgtcgtcgttgttcgccgtacgggtttccgggtccctaccgttccggttcgtaggtcggacaacggtctacgtggacgtacgtagttactttttcgtcgttacgttacctattcctacgttacggttactaacgtcgttacgtacggaccggtacggaccgtactaacgttacgttactttcctacggttaaccaactaccttacgtccgttaccccttaccccttaacccccgttaagttaaccggttttccggtaaccggtaacgggtaacccttaagttacgaaacctagtaaccgtaacgttaccgaacgttggtacggtactacgtacctaccgtattcgttcgtaccttaccg

SEQ ID NO: 273096 - DNA, 711 bp, Homo sapiens
  misc_feature: GYAE6OF01B6YEA.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatcgacccagtccgccacgccctccctgtctgcaaggtgtgggagacagtacgttccttacccgtttttggccgggtcgtacggtccggccctagttcggaccgtacgttggtttcggccgttggtacgttccggcggttggacggacccgacgggcctaacccttccgtcaactttctagacttacttaccgttcactcgcttgttcgcgtcggttcgggtcccctacgttcggtcgaggtcggaccgtaacggtcttccgtagacgtacgtaggtttactttttccgtacgttccgttctacttccgtacgttcggttactacgtcggtactacgaccggacggtcgtacgtaacgttcgttaccttcgtacgtacctaaacgtaccttacgtcccgtacccctttacccccttaccccccgtttaattaacccggttttcccgggaaccggtaaccgggggtaaccttaaacgggttacaaaccgtacgttaacctaacggtaccgtacgtggtacggtccttacgacctaactcgttcgttacccg

SEQ ID NO: 273097 - DNA, 575 bp, Homo sapiens
  misc_feature: GYAE6OF01D88VG.43.33.C11.1.454.CMB.1.raw
tcagtgtgagtagtcacgaccggtgctcgatttagagtgagctcgttgggtttgggggcagaagtctctctcagtcaggacacagcatggacagtgagggtccctgctcagctcctgggactcctgctgctctggctcccagattccagatgtgacatccagatgacccagtcgccagcctccctgtctgcaagtgtgggagacagagtctacctttttgccgggcgagtcggcccattgacgactgtttggcctggtatcgcgtgagaccgagggccaacctcctcaacttctgatactaccgttcatcgcttgttcgcgtacggttcgggtcccctaccgtcggttcagtggacaacggctcgtgagactagtatttttctcttcgtcatctacgtggttctactagtctgaccggacggcactaattgttacttctgtaccaactacttatcgacccttcccttaccccccttaataacgtttccggacgtacggggtaacctaaggttacaaacctattacgaacttaccgaacgttggtacggtcctacgaccctacctagttcgttacg

SEQ ID NO: 273098 - DNA, 687 bp, Homo sapiens
  misc_feature: GYAE6OF01CD4IK.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcgccattgacgactgttggcctggtatcgcgtgagaccagggcaacctcctcaacttctgatactaccgttcatcgtctgttcgcgtacggttcggggtccctaccgttccggttcacggtggaccgaacggtctcgtagacgtacgtacgttacttttttactcgttcgttactacttccgtaacgtttcgggttaccttaaccgtacggttccttacgggaaccggtaccgggtaccgtaccgtaaagtttccgttaacctttccgttacgttaaccaaaccttaccttaacgttcccggttaccccttcccccgttacccccccttaacgttaaccgttttacccgggtaccggtaacggggtaaccctaaggttaaccgtaaactacgttaccaaacgttacgtaaacgttggtacggccttacggtacccaccgttattccttgttccttacccg

SEQ ID NO: 273099 - DNA, 519 bp, Homo sapiens
  misc_feature: GYAE6OF01BHNRU.43.33.C11.1.454.CMB.1.raw
  modified_base (373)..(373): a, c, t, g, unknown or other
  misc_feature (373)..(373): n is a, c, g, or t
  modified_base (512)..(512): a, c, t, g, unknown or other
  misc_feature (512)..(512): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtctacctttttgccgggcgagtcggccattgacgactgttggcctggtatcgcgtgagaccaggcaacctcctcacttctgatactaccgttcatcgtctgtgcgtacggtttgggtcccacgttcggttcagtggactaacgggctcgtgacgacagtacttttcncttcgtcatcactcgtctacagtctagacgacgcgactaatgtaccttctagtaccaactactactcgccctcctcccctatacttcggacgacggactagttagaactgtacaatcgaactggtacgctagaccactntcgttcg

SEQ ID NO: 273100 - DNA, 762 bp, Homo sapiens
  misc_feature: GYAE6OF01DPNR0.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatcgacccagtccgccacgccctccctgtctgcaagtggtagggagacagtacgttccttacccgttttttcggccggggtacgtacggtcccggtaccctagttacggaaccgtacgtttcggtttcggcccgtttaggttacgtccggtcgttacggacggaccggacgggacctaacccttcccgtactaaaccgttctacggtaattaccttaccgttctattccgtcttgttcgccgtaccgggtttccgggtacccctaccgttcggtcgtaggtccgacgtaaccggtctccgtagacgtactagtttactttttcaccgttcgtactacgttactaacgttcggttaaccttacgtacgttaccgtacggtaaccggaccggtcgtaacgttaacgttcgtttaactttcttaacggtacctaaaccttcgttaccgttcccgttaccccttaccccgttaaccccccttagttaacccggtttacccggtaccggtaaaccgggtaaacccttaacggttacgaaaccttacgtaaccgtaaccgtaccggtaacgttcgggtacgtaccgtccgaaccctccgttacg

SEQ ID NO: 273101 - DNA, 589 bp, Homo sapiens
  misc_feature: GYAE6OF01C6I64.43.33.C11.1.454.CMB.1.raw
  modified_base (423)..(423): a, c, t, g, unknown or other
  misc_feature (423)..(423): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgactgttggcctggtatcgcgtgacgaccgagggaccaacctcctctaacttctgtactactaccgttcacttcgtcttgttcgcgtacggttcggggtcccctaccgttcggttcaggttcggacgaacggtctcgtaggacgtactagtttacttttctcttcgtctatctacgtgttactacngtctgaacggacggcactaattcgttaccttctcgtacaactactactccgtacccttcccttacccctaatacgtttccggtacgacgggtacctaaggttacaactagtacgaaactacgtaacgttggtacgtactcgacctacctattcctgttccttaccg

SEQ ID NO: 273102 - DNA, 505 bp, Homo sapiens
  misc_feature: GYAE6OF01DSEY1.43.33.C11.1.454.CMB.1.raw
  modified_base (369)..(369): a, c, t, g, unknown or other
  misc_feature (369)..(369): n is a, c, g, or t
  modified_base (499)..(499): a, c, t, g, unknown or other
  misc_feature (499)..(499): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggccaggtatcgcgtgagaccagggcaacctcctcaacttctgatataccgttcatcgctgttgcacgttcgggtcccactcggttcagtggcaacggctctgagactagtatttttcnctcgtcatcactggtctactagtctagacgacggcgctaatcgtactttctgtcaacactatcgcctcctcccccttatactttcggcacgggaccaagttgaacatacaatcgaactgcgtctagcacntcttcg

SEQ ID NO: 273103 - DNA, 547 bp, Homo sapiens
  misc_feature: GYAE6OF01BKN5P.43.33.C11.1.454.CMB.1.raw
  modified_base (301)..(301): a, c, t, g, unknown or other
  misc_feature (301)..(301): n is a, c, g, or t
  modified_base (445)..(445): a, c, t, g, unknown or other
  misc_feature (445)..(445): n is a, c, g, or t
  modified_base (539)..(539): a, c, t, g, unknown or other
  misc_feature (539)..(539): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtctaccctttttggccgggcgagtcggccctagttgacgtacttggtttcggcctggtatcggcgtgagaccgagggccaacctcctcaacttcngtatactaccgttcagtcgtctgttgcgtacggttcgggtcccacgttcggtcagtgcgtaacgctcgtgagactagtattttctctcgtctatcacgtgtctacgtagtctagacgacggcactaatgtactctgtaccaacncttatcgtccctccctacccctactaacgttcgaccgtacgggtacctaagttacgaactacttacaagttcgaacgttgtcgtctcgacactntcgttacg

SEQ ID NO: 273104 - DNA, 631 bp, Homo sapiens
  misc_feature: GYAE6OF01C2Q2P.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctccgtgggactcctgctgctctggcctcccagacttccagatgtgacatccagatcgacccagtccgccacgcccttccctcgtctcgacgtaaggtggtagggagacgacgtacgttaccttacccgtttttcggccgggtcggtacggtccggtaccctagttacggaccgtacgttcggtttcggccgttggtacgtcggcgtagacgaccgacggacctacctcctactaacttcgtagtactacgtaccttcactcgtcgtgttcgcgtacggttcggtccctacgttcggtacgtaggtcggaccgaacggtctcgtaggacgtacgtagtttacttttcctcttacgtctactctacgtcggtctacgcgttcacgacgcgctatactcgtacttctacgtaccaactacttatcccgtaccctacccctacccttagttacgttcggacgtacgggtacctaggtacaactacgtactaacgtcgtacgtgcgtactcacctactgtcgttc

SEQ ID NO: 273105 - DNA, 836 bp, Homo sapiens
  misc_feature: GYAE6OF01CUDTM.43.33.C11.1.454.CMB.1.raw
tcagtgtgagtagtcacgaccggtgctcgatttagagtgagctcgttgggtttgggggaagtctctctcagtcaggacacagcatggacatgagggtcctgctcagctctgggactcctgctgctctggcctccagtacttccagtatgtagacatccagatcgaccagtccgccacgcctcctgtctgcgtaaggtgtagggagacgagtacgttaccgttaccgtttttcggccgggtcgacggtccggtacccgtagtcggtaccgtacgttcggtttcgggccgttggtactcggcgtacggacgaccgagggccctaacctccgtactaacttctacgtaacttaccgtaccgttactacgttcggacgttcgttacgccggttacgggttccgggtacccgtaaccggtttccggggttacgtacgggtacgggtaccgtaaacccggtcgtacgtacggtaacgtaaccgttacgtttacgtttttaccgtccgttccggttactaacgttacccgttaccgttacggtttaaccgtaacggttacggtttacccggtaaccggaaccgggtaaccgggtacgttaaccggtaacggtttaccggtttccgttaccgttaacgttaacgaaactttacccgttaacctcccggttaccccttaccccctttaaccccccgttaacgtttacggttaccggttacccgggacgggtaaaccctaaggtaaccggaaacctaacgttaacgtaaaccggttacggttaaccgtggtaccggttaccctacgtaacccacgttacccgtttacttcggtttcccttaaccgg

SEQ ID NO: 273106 - DNA, 738 bp, Homo sapiens
  misc_feature: GYAE6OF01AVV40.43.33.C11.1.454.CMB.1.raw
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
tcagtgtgagtagtcacgaccggtgctcgatttagagtgagctcgttgggtttgggggtcgaggaagtctctctcagtcaggacacagcatggacatggacggtcccgtgctcagctccgtggctcctggctgctctcggctcccagtacttccagatcgtgacactccagatacgaccagtccgcacgcctcctgtcagacgagtggtggagacagtacgttccttaccgttttcggcgggcggtacgtccggacctaggttcgaccgttacgttggtttcggaccttggtacgtccgtcgtacggacgtaccgacgggcctacgttacctctaacgttctacgtatcttacgtcactcgtnttcgtgccgtacggttccgtccgtacctggttcaggtcgacgtacgtntcggacgacncgttacttacttttctcgtacgnttacgtcgtaacgttcgtactacgttatacggtacgtaccgggaacgtcgtaaacttaacggtttcttaacccggtttacgttaacttaacccgttaaaacgtcgttaccgttaccgttaacccccttcccccgttttaaacccggttactttaaccgggggttaccgttacggggaaacccggttaaccttaaaaggttaccgtaaactactaacccgttaaaccggtaacggtttaccggtttcggaccgtttacggttaacccacccggaaacgtttcctttcggttaacg

SEQ ID NO: 273107 - DNA, 718 bp, Homo sapiens
  misc_feature: GYAE6OF01C0V44.43.33.C11.1.454.CMB.1.raw
  modified_base (457)..(457): a, c, t, g, unknown or other
  misc_feature (457)..(457): n is a, c, g, or t
tcagtgtgagtagtcacgaccggtgctcgatttagagtgagctcggttggggtttgggggcagaagtctctctcagtcaggacacagcatggacatggacgggtccctgctcagctccgtgggctcctgctgctctggctccatattccagatgtgacatccagatcgacccagtccgccacgccctcctgtctgacgaaggtgtagggagacgagtacgttccttaccgtttttcggccgggcgacggtccggcctagttacgacgtacgttggttcggccttaggtactcggcgtacgacgaccgacggacctaaccctcctactaacttcgtagtaacttacgtaccgttcacgtacgtcttcggttcgaccgttaccggttccgggtaccctaccgttcggttacgaggtcggaccgtaacgtcgtgtacgaacgtactagtttacttttccncttacgtctaatctacgttgtacctagtacgtacgtaacggaccggacggtacgtaacttaagtacgttaacctttctacgtaaccaaacttaccgttactcccggttaacccccttccccgttaaaccccccgttaagtttaaccggtttacccgggtacggtaaaaccggggtaaccttaaagggttaaccgaaaccttaagtaacccgtaaagtccgtaacgtcggtacggtacctacgaccctactgttcgttaccg

SEQ ID NO: 273108 - DNA, 988 bp, Homo sapiens
  misc_feature: GYAE6OF01CXJH3.43.33.C11.1.454.CMB.1.raw
tcagtgtgagtagtcacgaccggtgctcgatttagagtgagctcggttgggtttgggggaagtctctctcagtcaggacacagcatggacatgagggtccctgctcagctctgggactcctgctgctctcggcctcccagattccagatgtgacatccagatcgaccagtccgccacgccctcctgtctgacaaggtggtagggagacgagacgttccttaccgtttttggccgggcgacggtccggcccgtagttcggaacgtacgtttcggttcggtccgttgggttacgtcggtacggtaggaacggacccggaacgggaccctaacccgttccctacctaaaccgtttctacggtaacttaaccgttacccgttactacgttcttcgttggttccggaccgttaccgggtttccggggtacccccttaaccggttccggggtttacgtaacgggttacggaacccgtaaaccggtccgttacgtacgggtaaacgtaacgtttaaacggtttacctttttttccgtaccgtttaccggttacttaacgttacccgttaaccggtttacggtttaaccccgttaacgttaacggtttacccggtaaccgggtaaccccggggtaaccgggtaccggtaaaccgttaaacggttttcccgtttaaacccgtttccggttaacggtaacccctaaaacgttaaccctttaacggttccccgttaaccccccgtttacccccctttaacccccccccgtttaaaacgtttaacccgggtttttacccggggtaaacccggtaaaacccggggggttaaacccttaaaaaccgggttttacgaaaaaccccgttaaacgttaacccggttaaaaccgttaacccgggttaaacccgtttcgggggttaacccggttaccccgtttaacggacccccgttaaacccgtttaaccttttcccggtttaccgtttaccccttttaaccccgg

SEQ ID NO: 273109 - DNA, 556 bp, Homo sapiens
  misc_feature: GYAE6OF01BZ5IM.43.33.C11.1.454.CMB.1.raw
  modified_base (407)..(407): a, c, t, g, unknown or other
  misc_feature (407)..(407): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggccattgacgacgtgtttggcctggtatcgcgtgagaccagggcaacctcctcaacttctgatataccgttcatcgctgttgctacggttcgggtcccacgtcggttcaggtggcaacggctctgacgactagtattttctctcgtcactcactgtactacgagtctgacgcggngcaatgtacttctcgtacaactctatcgccctcctaccccccttaactaacgtttaccgggaaacgggtacctaaggttacgaaactactacgaacttacgaaccgttcgtacggtaccttggaccctaacccgattccgtgtttaccc

SEQ ID NO: 273110 - DNA, 517 bp, Homo sapiens
  misc_feature: GYAE6OF01BD7W8.43.33.C11.1.454.CMB.1.raw
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
  modified_base (509)..(509): a, c, t, g, unknown or other
  misc_feature (509)..(509): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgctacgttcgggtcccacctcggttcagtggcaacggctcngagacagtattttctctcgtcatcactggtctacngtctgacgacggcacagtgtacttctgtacaactactatcgcctcctaccccctactaacttccggtacgacgggtacctaagttacgaacgtactacaactcgaactgtgtctgacaccnttcttacg

SEQ ID NO: 273111 - DNA, 586 bp, Homo sapiens
  misc_feature: GYAE6OF01E5AT4.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtctacccttttttgccgggcgagtcggcccattgacgactgtttggcctggtatcgcgtgagaccagggcaacctcctcaacttctgatactaccgttcatcgtctgttcgctacgttcggggtccccaccgttcggttcgagtcggacgaacggctctgagactagtatttttctctcgtcatcactggtcctacagtctgacgacggcgtacaattgttaccttcgtagtccaaactacttacttcgcccttcccttaccccccctacttaaccgtttccgggtaccgtaaccgggggtaaccctaaaggttccgaaacctactaccaaacgttaccgtaaacgttcggtacggtacctcgcccaaccgttacg

SEQ ID NO: 273112 - DNA, 626 bp, Homo sapiens
  misc_feature: GYAE6OF01AHAE1.43.33.C11.1.454.CMB.1.raw
  modified_base (354)..(354): a, c, t, g, unknown or other
  misc_feature (354)..(354): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggtcgagtccggcccattgacgtactgtttggcctggtatcgcgtgagaccgagggaccaaccctcctacaaaccttctagatactaccgttcatcgctgttgcgtacggttcgggtcccacgttcggtcngtcggcaacggctcgtgacgtactagttacttttctcttcgtctacttcctacgttcggtccttacgtacggttcgtcggaaccggaccgggtcgtactaacgttgttaacctttcgtcgtacctaactaccttactccgtccccttccccttaccccccttaagttacccgtttccggaccggtaacggggtacctaaaggttacgtaaacgtctaccgtaacgtaccgtaacgttcggtacggtctacggaccaccttgttccgttaccg

SEQ ID NO: 273113 - DNA, 678 bp, Homo sapiens
  misc_feature: GYAE6OF01D3TBG.43.33.C11.1.454.CMB.1.raw
  modified_base (290)..(290): a, c, t, g, unknown or other
  misc_feature (290)..(290): n is a, c, g, or t
tcagtgtgagtagtcacgaccggtgctcgatttagagtgagctcgttgggtttgggggaagtctctctcagtcaggacacagcatggacatgagggtccctgctcagctcctggactcctgctgctctggctcccagattccagatgtgacatccagatgacccagtcgccagcctccctgtctgcaagtgtgggagacagacgtcctacctttttgccggtcgagtccggccatgacgacttgttggcctggtatcgcgtgagaccgagggcaaccgtcctcaacttcngatataccgttcatcgctgttcgctaccggttcgggtcccctaccgtcggttcgaggttcggactaacggctcgtaggagtacgtagtatttttccgtccttcgtacctacttcctaacgttggtaccttacgtagttccgttacggaacgaccgggtccgtaccgtaagtttaccggttacctttacgtcgttaaccctaaacctacttactcggtaccccctttccccttacccccccttaacgttaaccgtttttcccgggtaccgttaccggggtaacctaaacggttacggaaaccttaagtaccgtaaacttacggtaaacgttcggtcggtaaccgttcgaaccccttaccgtactttaccgtcgtttaccgtttaccccg

SEQ ID NO: 273114 - DNA, 559 bp, Homo sapiens
  misc_feature: GYAE6OF01AU51T.43.33.C11.1.454.CMB.1.raw
  modified_base (552)..(552): a, c, t, g, unknown or other
  misc_feature (552)..(552): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgactataccgttcatcgctgttcgctacggttcgggtcccacgtcggttcaggtcggcaacggtctcgtgacgtacaggttactttttctcttcgtcatctactggtcctactacgttctgaccgacgggcgtcaactcgttaccttcttcgtaccaactactatcgtccctacccttccccctaactaacgtttccggtccgagggaccctaagttacgaactcgtactaactcgtaacgtcgtaggtcctgaccacctntcgttcg

SEQ ID NO: 273115 - DNA, 559 bp, Homo sapiens
  misc_feature: GYAE6OF01B6210.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggccattgacgactgtttggcctggtatcgcgtgagaccagggcaacctcctcaacttctgatactaccgttcactcgctgttgcgtacggttcgggtcccacctcggttcagtggcaacggctctgacgtactagtacttttctctcgtcactcactcggtctactagtctacgacgacggcgactaagtcgttacttctcgtacaactactatcgtcccttccctacccccttactaacgtttcggtaccgacggggtaacctaaggttacgaaacactacgtaactacgtaacgtcggtcgactcgaccacctatctcgttcttaccg

SEQ ID NO: 273116 - DNA, 665 bp, Homo sapiens
  misc_feature: GYAE6OF01CU9EX.43.33.C11.1.454.CMB.1.raw
  modified_base (452)..(452): a, c, t, g, unknown or other
  misc_feature (452)..(452): n is a, c, g, or t
  modified_base (648)..(648): a, c, t, g, unknown or other
  misc_feature (648)..(648): n is a, c, g, or t
tcagtgtgagtagtcacgaccggtgctcgatttagagtgagctcgttggggtttgggggaagtctctctcagtcaggacacagcatggacatggagggtccctgctcagctcctgggactcctgctgctctgcctccagacttccagatgtgacatccagactcgaccagtcgccacgcctcctgtctgactaaggtggtagggacgacgagtacgtccttttaccgttttcggccgggtcgacggtccgcctagttcgacgtacgttcggtttcggccgttggtacgtcggcggtaggaacgaccgacgggacctaaccgtcctacctaactttcgacgtactacgttaccgttcacgtccgtcttgtcgcgtaccggttcgggaccctacggttcggttacgacggtcggaccgaacggtctacgtaggacgtaacgtagtttcttttcncgtcgttacactcgtacttcgtactacgtacgtctacggtacggtacggcgtactaagttcgttaacttccgtacgtactaactacttacgtccacccttccctaccccgttaacttaccggttcgtacggaacgggtactaagttacaaactctaacgtacgtaccgtattcggtacggtctacgtaccacgttntacttcgttcttacccg

SEQ ID NO: 273117 - DNA, 681 bp, Homo sapiens
  misc_feature: GYAE6OF01BIHDM.43.33.C11.1.454.CMB.1.raw
  modified_base (470)..(470): a, c, t, g, unknown or other
  misc_feature (470)..(470): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctcctgtctgcaagtgtgggagacagacgtcctacccgtttttcggccgggtcggtacggtccggaccctagtttcggacgtacttggttttcgggcccttgggttactcggcgtggaacgaaccgaggggacctaacccttcctacgtaaacctttcgtagtacttacttacccgttcacttcgtcttgttcgcgtacggttcgggtccctacgttcggttcacggtcggaccaacggtctacgtgaagtactacgttatttttcgcttcgtactactctacgtgtctacncgtcgtacggaccgacggtacgactaacgttcgttaccttctacgtacctaactacttaccccttacgccccttacccttacccccgttaacttaaccgtttccggtaaccggtaacgggttaaaccgtaacggttaccgaaacgtactacgtaaacgtcgttaaaccggttggacgtactaccgtaacctaccaccgtttcgttaacccg

SEQ ID NO: 273118 - DNA, 728 bp, Homo sapiens
  misc_feature: GYAE6OF01C9R5U.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtcgccagccctccctgtctgcgaagtggtgggagacagtagttcctaccgtttttcggccgggcgtacgtccggcctagttgaccgtacgttgtttcggccgttggtacgtcggcgtaggacgaccgacggaccaaccgtcctactaacttctgacttacttaccgtcacgtcgtctgttcgcgtacggttccgggtccctcgttcggttctaggtcggacgaacggtctcgtagacgtactagtttacttttctcgttctactacttccgtacgttcggttaccttacgtacggttccgtacggaaccggaccgggtaccgtacgtaacgtttcgttaccgttccttacgtaacctaacctacttaactcccgtacccctttaccccttacccccgttaagttaaccggtttcccgggtaaccggtaaccggggttaaaccccttaaaggttaccgaaaccgttacttaaacccggtaaacgttacccgtaaacgtttcgggtaccgttaccgttacccgacctaacccgttcgtttcccttcggtttcccttaacccg

SEQ ID NO: 273119 - DNA, 868 bp, Homo sapiens
  misc_feature: GYAE6OF01B0XNV.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctcctgtctgcaagtgtgggagacagagttctacccgttttttcggccgggtcgacggtccggccctagttgacgtacttggtttggccttggtactcggcgtgacgaccgagggccaaccctcctctaaccttctagtactacttacccgttctacttccgtcttcgttgtccgtaacggtttccgggtcccgtaccgttcggttcgaggttcggaccgtaacggtccttacgtagacgtaacgttagttacttttttccgtccgtttaccgtcttaacgttccgtaaccgttcgggttaacccttaacccgtacggttaccgttacgggtaacccggtaaccgggtaccgtaaccgtaaacgttttaccggttaaccgtttttaccgttaacggttacccgtaaaaccgttaaccgtttaaccgttacccggttacccccctttaacccccgtttaaccccccccggttaaaccgtttttaaaccgggttttaccccggggtaaacccgggtttaaacccggggggggtaaaacccctttaaaccggggtttaaaaccgtaaaacccgttaaccgtttaaacccggttaaaacggtttacccgggttaaaaccggtttcggggttaacccgggttacccgttacggtaaccccttaaccccgtttaaagtttccccgttttaacccgg

SEQ ID NO: 273120 - DNA, 626 bp, Homo sapiens
  misc_feature: GYAE6OF01CHA6T.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacccgtttttgccgggcgagtccggcccattcgacgacttgtttggcctggtatcgcgtgagaccagggcaacctcctacaacttctgtactaataccgttcattccgctgtttcgcgtaccggtttcggggtccccctacgttccgggttactaggttcggaccgaaacgggtcctcgtgaacgactaggttactttttctcttcgtctatctaaccttggtactacgtacgttcgtagaccgacgggtccgataaacttcgttacttctagtaccaacgtactactcgtaccctccctacccccttaataacgttttccgacggtaacgggtaacctaaaggttacgaacgtaactacgtaaactaccggtaacgtacggtacggtacctacgaccaaccttacgtccgttacg

SEQ ID NO: 273121 - DNA, 537 bp, Homo sapiens
  misc_feature: GYAE6OF01AWJQJ.43.33.C11.1.454.CMB.1.raw
  modified_base (371)..(371): a, c, t, g, unknown or other
  misc_feature (371)..(371): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgactgtttggcctggtatcgcgtgagaccagggcaaccgtcctcaacttctgatataccgttcatcgctgttgcctacggttcgggtcccacgtcggttcagtggacaacggctctgagacagtattttcnctcgtctatcactggtctactcgtctgaccgcggcgtcaagtgtacttctcgtacaactactatcgtcccttccctacccccttatacgtttcggaccgacgggtacctaagttacgaactactacaacgtcgtaacgtgtcggtcctagacctacctgtcttccg

SEQ ID NO: 273122 - DNA, 666 bp, Homo sapiens
  misc_feature: GYAE6OF01B9CYI.43.33.C11.1.454.CMB.1.raw
  modified_base (657)..(657): a, c, t, g, unknown or other
  misc_feature (657)..(657): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactctgctgctctgctcccagattccagatgtgacatccagatcgacccagtccgccacgccctccctgtctcgactaaggtggtgggaacgtacgagtacgttccttacccgtttttcggccgggtcgacggtccggccctagttcgaccgtacgttggtttcggccgttggtactccggtcggtggaacgaccgacgggacctaacccgtcctaccgtaaccttccgtagtaacttacttaccgttcacttcgtcttcgttcgccgttacgggttccgggtcccctacgttccgggttacacggtcggacgaaccggtctcgtacgacgtactagtttacttttctcttcgtactacgtactacgttacgtacttacgtgtactacggaccgacggctactagtcgttacttcgtgtacactactactccgtccccttacccttaccccttaataccggttcgtaaccggacggtacctaaaggttacaacctacgtactaaccgtacgttacgtggtacgtacctcgaccctactnttcgttacg

SEQ ID NO: 273123 - DNA, 593 bp, Homo sapiens
  misc_feature: GYAE6OF01DYALS.43.33.C11.1.454.CMB.1.raw
  modified_base (586)..(586): a, c, t, g, unknown or other
  misc_feature (586)..(586): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctcctgtctgcaagtgtgggagacagacgtctacccttttttggccgggcgagtcggccattgacgactgtttggcctggtatcgcgtgacgaccgaggggccaaacctccgtactaaacttcctggtacttacttacccggtttcaattcgtccttggttgccgtacggtttcggggtcccctaccgttcggttcaggttcggacaacggtctcgtgacgactacgttatttttctcttcgtctacttcacgttggtctacagtcgtagaccgcggcgctatcgttacttcgtgtactaactactagtcgtcccttccctaccccctacttacgtttccggacgtaccggggtaacctaaggttacgtaactactacaaactcgtaacttggtacgtctcgtcnccttacg

SEQ ID NO: 273124 - DNA, 786 bp, Homo sapiens
  misc_feature: GYAE6OF01DX97U.43.33.C11.1.454.CMB.1.raw
tcagtgtgagtagtcacgaccggtgctcgatttagagtgagctcgttgggtttgggggcagaagtctctctcagtcaggacgacagcatggacatgagggtccctgctcagctcctgggactcctgctgctctaggctcccagattccagatgtgacatccagatgacccagtcgccagcctcctgtctgctaagtgtgggagacagtagtcctacctttttgccgggtcgtagtcggcccattgacgactgtttggcctggtatcgcgtgacgaccagggcaacctctccaacttctagatacttaccgtttcaacgtcgtctcgttcgccgtaccggtttcggggtcccctaccgttccgggttcgaacggttcggaccgtaacgggtccttccgtagacggtaccttaacggtacttttttaccgtaccgttaccggttcctaacgttcccgtaaccgttcgggttaacccttaacccggtacggttacccgttacgggaaccccgggtaacccgggtaccggtacccgtaaacgtttcggttaaccttttccgtacgggttaaccctaaaccgtacccgtttaactcccggtacccccctttacccttaacccccccccgttaagttaacccgttttccgggtaacccgtaaccgggggttaaccccttaaaacggtttacggtaaacccgtacttaaccgtaaaccgttacccggtaaaaccttcgggttaacggtacccttaacggacccttaaaccccgtagttcccgtttaacccggg

SEQ ID NO: 273125 - DNA, 701 bp, Homo sapiens
  misc_feature: GYAE6OF01D1WQ6.43.33.C11.1.454.CMB.1.raw
  modified_base (406)..(406): a, c, t, g, unknown or other
  misc_feature (406)..(406): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtccgccagccctccctgtctgcaaggtgtgggagacgagacgttcctacccgtttttcggccggggccgtacggtcccggccctagttcggaccgtacgttggttttcggaccgttggttatccggcgtagaacgtaccgacgggacctaacccgtcctacctaactttcgtagtaacttacgttaccgttcactcgtcttagttcgcgtacggttcgggtccctaccgtcggttacnggtcgacacggtctcgtagacgtactagtttacttttctctacgtactactcgtacgttcgttactacgtacgttctacggaccgtaacggtcctaacttaagttcgtttaccttcgttacgtaacctaacctacttacgtccctacccttacccccgttaccccccttaagttaccgtttccggtaacggtaccggggtaaccttaaggttacgaaccgtaataccgtaaacgttaccggtaacttggtacggtcctacggtaccctaacgttacttcgttccttcttaacccg

SEQ ID NO: 273126 - DNA, 669 bp, Homo sapiens
  misc_feature: GYAE6OF01E1AAU.43.33.C11.1.454.CMB.1.raw
  modified_base (207)..(207): a, c, t, g, unknown or other
  misc_feature (207)..(207): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtccgccacgcctccctgtctgcaagtggtggganacagagtcctaccctttttggccgggcgacgtccggcccattgacgtacttgttggccgtggtactcgcgtgacgaccgacgggccaacctcctacaacttctgatacttaccgttcattcgcgttgttgccgtaccggttcgggtacccctaccgttcgggttcgtagggtcggccgtaaccggcttcgtagacggtactagtttactttttcctctacgttctactcctacgttcggttaccttacgtagttccgtacggaaccggaccggtcgtacctaagttccgtttaaccgtttcgtagtaacccaacttaaccttacgttacccgttaccccgttcccctaaccccccctttacgttaacggtttccgggtaaccgtaccggggaaccttaacggttacaaacgttactaactaacgttaccgtaaacttcggtaggacctcgacctaccgtacg

SEQ ID NO: 273127 - DNA, 660 bp, Homo sapiens
  misc_feature: GYAE6OF01D24CT.43.33.C11.1.454.CMB.1.raw
  modified_base (486)..(486): a, c, t, g, unknown or other
  misc_feature (486)..(486): n is a, c, g, or t
  modified_base (648)..(648): a, c, t, g, unknown or other
  misc_feature (648)..(648): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatcgacccagtcgccacgcctccctgtctgcaagtgtggagacagagtcctaccgtttttggccgggcgacgtcggccctagttcgacgtacgttgttcggccgtggtatcggcgtgacgaccgacgggccaacctcctactaacttcgtagtacttacgtaccgttacatcgcgttagtcgtccgtcgggttcgggtcccctaccgttcggttaccgaggtcggacaaccggtctacgtaggacgtactagttactttttctcgttaccgtcacgttcctacgttcggttacctacgtacgtcgtacgtaaccggaccggngtacctaagttccgttacgtttaccgttcgtacctaactaccttactcgtaccccttccccttaccccctacgttacgttttccggtacggtaccggggtaaccttaacggttaacgaaccgttactacctaaacggtacctaacggttggtacgtctaccnccgtaccgtacg

SEQ ID NO: 273128 - DNA, 958 bp, Homo sapiens
  misc_feature: GYAE6OF01DQIM8.43.33.C11.1.454.CMB.1.raw
  modified_base (939)..(939): a, c, t, g, unknown or other
  misc_feature (939)..(939): n is a, c, g, or t
tcagtgtgagtagtcacgaccggtgctcgatttagagtgagctcggttggggtttgggggcagaagtctctctcagtcaggacacagcatggacatggacgggtccctgctcagctccgtgggctcctgctgctcgtcggcctcccagtacttccagtatgtacgacactaccgagactaccgacccgtacggtccgacctaccgtcccttccgtcgtacgtcggacgtaggtggtagggacgacgacggtacgttcccgtttacccggttttcggccgggtcggtacggtccggtaccgtagttacggtacgttacggtttcggttcggtccgttaggttacggtccggtacggtacggaaccggaccggtacgggtaccttaacccgtcctaccttaccgtttacgtacgttacttaccgttaccgtttacgacgttccgttcgtacggtttccggtaccggttaccgggttcccgggttaccccgtaccggtttacgggtacgtacgggtaccggaccgtaccggtcgttacgtacggtaacgtacgtttaacgttttccgtttttcgtaccgttccgttacgttaaccttaccggtaccgtttaccggttacgttacgttaacccggtcggttaaccgggaccgggtccgttaaccgtaacgtttaaccgtttaccgggtttaacctttacccgttaacggttaacccttaaaacccgtttccgtaaccgtttcccccggtaaccccccttttaaacccccggtaacccccgtttaagggtttaccccgggtttaacccgggtaaacccggggttaaccgggttaaaccccgtttaaacggtaaccgtaaccgtaaaccggtttaaccttaaacgggtacccgtttaacggttaaccgggtccgtaacctttaacccgaccctttaacccggttnttaccccggttttaacccg

SEQ ID NO: 273129 - DNA, 603 bp, Homo sapiens
  misc_feature: GYAE6OF01BF7JA.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttggccgggcgagtccggcccagttgacgactgtttggcctggtatcgcgtgagaccgagggccaacctcctacaacttctagtactactaccgtcatcgtctgttgcgtacggttcgggtcccacgtcgttcagtcggcaacggctcgtgagactagtattttctctcgtacactcctacgtcggttactacgtacgttctacggaaccggacggactacgtaacttcgttactttctacgtaccaaactactatccgtaccctccccttacccccttaattaccgtttcggaccggtaacgggtaacctaaaggttacgaaaccgtcttacgaaacttacggtaaacgtcggttcgacttacgaccgtaacctagttcttaccg

SEQ ID NO: 273130 - DNA, 635 bp, Homo sapiens
  misc_feature: GYAE6OF01ASU1J.43.33.C11.1.454.CMB.1.raw
  modified_base (299)..(299): a, c, t, g, unknown or other
  misc_feature (299)..(299): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctcgctctggctcccagattccagatgtgacatccagatgacccagtcgccagcctccctgtctgcaagtgtggagacagagtctacctttttgccgggcgacgtcggcccagttgacgtactgtttggcctggtactcgcgtgacgaccgagggccaacctcctacaacttcngtatactaccgtcatcgctgtcgcgtacggttcgggtccctaccgtcggttcaggtcggacaacggtctcgtacgacgactagttacttttccgtcttcgtacctatcctacgttcggttactacaagttcgtacggaccggacggtcgacgttaagtcgttaaccttcgttagttacctaaactaccgttacgtaccgtacccttccccgttaaccccccttaagttaccgtttaccggtaccgtaaccggggttacctaacgttaccgaactaacgttacaaacgttccgtaaacgtagtccggtactacgtaccgtaactcgttcgttacccg

SEQ ID NO: 273131 - DNA, 834 bp, Homo sapiens
  misc_feature: GYAE6OF01DHAND.43.33.C11.1.454.CMB.1.raw
  modified_base (194)..(194): a, c, t, g, unknown or other
  misc_feature (194)..(194): n is a, c, g, or t
tcagtgtgagtagtcacgaccggtgctcgatttagagtgagctcggttggggtttgggggcagaagtctctctcagtcaggacacagcatggacatggacgggtccctgctcagctccgtgggactcctgctgctcgtcgcctccagtacttccgagatgtcgacactaccagacgtccgacccgagtccgccncgtcccttccctggtctggacgtaagggttggagggaacacgtaggtaacgttccgtttaccggttttcgggaccgggtacgtacggtccggaccctagttcggtaccgtacgttggttcggtccgttggtactcgggtcgtaggaccgacggtacggtacctaaccgtcctacctaacgttcgtagtaaccttaccgttaccgtacgtaccgttcgtacgtttcgggtaccggtaccggttaccggggttacccgggtttacccaccgggtttggtaacggcgggttacggaccgtaacggttcctaggtacggtactaacgttgtttacgtttccgtacttcgtactacgtacgtacgttcgttacctaacgttcggttacgtacggacggaccgggtccttaacggtaactttccggttacttcgttaacggtacctaaaccgttcgttaacccgtccccgtaacccccctttcccgtaaaccccgtttaacggttaacccggtttaccgggaccgggttttaaaccggggaaaccctttaaaggaaccgtaaccgttaaccgttacggtaaaccggttcgtaccggtttcgggaccgttacgaccccgttataaaccttcgttaacccgtttcccg

SEQ ID NO: 273132 - DNA, 690 bp, Homo sapiens
  misc_feature: GYAE6OF01DSHTL.43.33.C11.1.454.CMB.1.raw
  modified_base (682)..(682): a, c, t, g, unknown or other
  misc_feature (682)..(682): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagacttccagatgtgacatccagatcgacccagtccgccacgccctcctgtctgcaaggtgtgggagacagtagtccttacccgtttttcggccgggcgtacggtccggaccctagttacggacgtacgttggtttcggccgttggtacgtcgcgtggacgaccgacgggacctaaccctccgtacctaaccgttcgtacgtaattactacccgttctacgtccgtcttaggttcgtaccgtaccggttccgggtacccctacggttccggttaccgacggtcggaccgtaacgtcgtactaggacgtactacgtttacttttcgtaccttcgtacgtactcgtacgttacgtactaacgtcggtacgtacggaccgtacggacgtacgtaacgtttcgtacctttcgtaacgtacctaaactacgttactcccgtaccccttccccttaaccccgtaacttacgtttaccggaccggtaaccggtaacctaacgttacgaacctactaactacgtacgtacgtcgtacgctacacctactntcttaccg

SEQ ID NO: 273133 - DNA, 737 bp, Homo sapiens
  misc_feature: GYAE6OF01CQ9LL.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactctgctgctctggctccagattccagatgtgacatccagatcgacccagtcgccagccttcctgtctgcaagtgtaggggagacaggtacgttccttaccccgttttttggccgggtcggtaacggtccggcccctagttacggtacgtaccgtttcggttttcgggccttgggttaacgtccggtacgtcggaacggaaccgtaacggggtaccctaacccgttcccgtaccttaaaccgttccgtagtaacttaacgttacccgtttcaacgttcgtacgttggttcgaccggtaccggttcgggtccccacggttcggttacgaggtcggacgaacggtcctagtacggtacgtacttaaggttactttttccgttcgtccggtactacgttaccgttacgttcggttaccttacgtcgttacgtacggtacccgtacgggacctacgtaacgttcttacgttcctacgtaaccgtaacttactacgtcccgtcccttacccttaccccttacttaaccgtttcgggtaacccggacgggtaacctagttagaacctaacgttacctaagttaccgacgttagtacgtcctacgtaccacgtacttcgttaccg

SEQ ID NO: 273134 - DNA, 768 bp, Homo sapiens
  misc_feature: GYAE6OF01BRA0I.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatcgacccagtcgccacgccctcctgtctgcaagtgtgggagacagagttctacccgtttttggccgggcgaggtccggccctagttcgacgtacttggtttacggcctggtatccggtcggtggtaacggacccgacggggacctaacccttcccgtacctaacctttccgtaggtaactttacgttaacccgtttctaacgttccggtcttcgggtttacggtaccgtaccggggttttcccgggggttaccccctacccggtttccgggtttaccggacggttcgggaccgtaaacccgggtccttacgtacggaacgtaaccgtagttttacgttttttcctcgttaccgttacctacttaccgtacgttcggttaccttacgtacgttacgtacggaaccgggtaccggtaccgtacgtaaacgtttcggttaaccctttcgttacgtacctaaacgttacttaacgtcccgtaccccttcccccttacccccccttaagttaaccgtttacccgggtaccggtacgggtaaccctaggttaccgaacgtactaacaacgttaccgtacgtggtaccggtctacgaccacctgtcgttaccg

SEQ ID NO: 273135 - DNA, 873 bp, Homo sapiens
  misc_feature: GYAE6OF01BQ8QY.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacactccagatcgacccagtccgccacgtcccttccctgtctgacgtaaggtggtagggagacgagtacgttccgttaccgtttttcggccgggacggtacggtccggtaccctagttcggtaaccgtacgtttcggtttcggtccgttaggttacgtccggtacggttacggaacggacccggtaacgggacccctaacccgttcccgtaaccttaacctttcgtacgtaacctttaccgttaacccggtttctaacgttcgtaccgttggttaccggtccgttaccgggtttcccgggtacccctaccggtttccgggtacgtacgggtcggtacccggtaaccggtccgttacgtacggtaacgtacgttacgttttaaccttttccgtaccgttccgtactaccgttacgtaccggtttcggttacctaaccgtggttaccggtacgggaacccgggtacggtaccgtaacgtttaacgtttaccgttaccgtttccggttaactaacctaaccgttattaacccttcccgttaccccccgtttaccccttaaccccccgtttaaagttacccggtttaccgggaccgggtaaaccgggtttaaacctaaggttaaacccggtaaacttaacctaaccgttaaacggttaaccccggtaaaggtttccggaaccggtacgtacccctaaccggttaactccggtttcgttaacccg

SEQ ID NO: 273136 - DNA, 867 bp, Homo sapiens
  misc_feature: GYAE6OF01A94F4.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtccgccacgccctccctgtctgacaaggtgtagggagacgagtacgtccttacccgtttttcggccgggcggtacggtccggtaccgtagttacggacgtacgttcggtttcggaccgttggttactccggtcggttacggaacggaccgaggggaccctaaccctcctaccgtaacttctagtactacttaccgttcacgtcgtacttcggttcgtaccggttccgggttccgggtaccctaccgttcggttacgtaggtacggtacgtaaccgtcgtacgtaggaacggtacgttacgtttacttttttaccgccgtttacggtacttacgtttaccgtaccgtttaccgggttaccgttaacgtaacgttacccggtaaccgggtaacccggtaccgggtaccgtaacgtttaacgttaccgtttaccgtttaccgttaaccggtaaccttaaaccgttaccgtttaccgttaccccgttaccccctttacccccgttaacccccccgttaaaccggtttaccgggtttaccccgggttaaccgggaacccggggttaaacccgttaaacgggtttaaaccggtaaaccgttaaccgttaacgtaaaccgtttacccggaacggtttcgggtacccggttaccgtaccggtaaccctacccggtttacctcccggtttacgtttcccccgttaacc

SEQ ID NO: 273137 - DNA, 658 bp, Homo sapiens
  misc_feature: GYAE6OF01EB9BU.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtcgccagcctccctgtctgcaagtggtggagacgagtacgtcctacccgtttttcgccgggtcgacggtccggcctagttcgacgtacgttggtttcggccttggtactcggtcgtcgacgaccgacgggcctaaccgtcctactaactttctacgtactaacttaccgttctactcgtcttggttcgtccgtaccggtttcgggtcccctacccggttcggttccgtaggtccggacgtaacggtctcgtagacgtacgtagtttactttttctccgttcgtactacttactacgttcgtacctactacgtcgtacgaccggacgacgactagttcgttacttctacgtacacctactactcctaccctccctacccctagttaccgtttccggtacggacggtacctaaggtactaacctagttaaccgaacgttacgtaacgttcggtacgtccgtacgtacctactatttccttgttcccttaacg

SEQ ID NO: 273138 - DNA, 601 bp, Homo sapiens
  misc_feature: GYAE6OF01A9D75.43.33.C11.1.454.CMB.1.raw
  modified_base (378)..(378): a, c, t, g, unknown or other
  misc_feature (378)..(378): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacccgtcctcaacttctagatactaccgttcactcgctagttgctacggttgggtcccacgtcggttcagtgcaacggctctgagacctagtacgtttttcncgttcgtcactcacgtcggtctacagtctgaccgacgacgactaagtgtacttctgtcaacgtacttaatcgtaccctcccgttaccccccctagttaaccgtttccggtaccgtaacggggtaccctaaacgggttcgtaaaccgtcgtaacccgtaaacttccggtaaaccgttgggttaccggtccgtacggtacccacccgtagttaccgttttcccgg

SEQ ID NO: 273139 - DNA, 672 bp, Homo sapiens
  misc_feature: GYAE6OF01C4VGK.43.33.C11.1.454.CMB.1.raw
  modified_base (200)..(200): a, c, t, g, unknown or other
  misc_feature (200)..(200): n is a, c, g, or t
  modified_base (653)..(653): a, c, t, g, unknown or other
  misc_feature (653)..(653): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtcgccagccctccctgtctgcaagtgtggganacagagtcctacctttttgccgggcgacgtccggccattgacgattgtttggccgttggtatcgcgtgacgaccgagggccaaccctcctacctaacttctagtactacttacccgttcatcgtcttaggtttcgacgtaccggttccggggtcccctaccgtttccggttcgacggtcgggaccaaccggtccttacgtggaacgtacgttacgtttacttttttccgtcttcgtactacttccgtacgttcggttacctacgtacgttcgtacggaacggtaccggccgtactaacgttcgttaccttcgttacgtaccaaactacttacgtccgtaccccttccccttaccccccgttaattaccgtttccggtacggtacgggtacctaaggttaacgaactactaccgtaaacgtacgtaacgttggacggtctacgtaccgaacctntttcctcgttccttacccg

SEQ ID NO: 273140 - DNA, 723 bp, Homo sapiens
  misc_feature: GYAE6OF01DK32I.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtcgccacgccctccctgtctgcaagtggtgggagacagagttcctacccgtttttggccgggcgtacggtccggcctagttcgaccgtacgttggtttcggccgttggtacgttccggcggtacggaacgaccggacgggtaccaaccctccctactaacctttctagtacttacttacccgttcactccgtcttgttcgccgtacggttccggggtcccctaccgttcggttacgtaggtcggacgaaccggtctcgtgaacgtactagtttacttttcgtccttcgtactacgtctacgttggttacctacgtacgttcgtacggaaccggaccggtacacgtaacttcggttaccttacgtacgtacctaactaccttcgtaccctccccttaccccccgttacccccgttaagttaaccggttttacccggtaaccgggtaccggggtaaaccttaacggttaccgaaaccgttactaaccgtaaaccgttacgtaacgttggtaccggttctaacgacccgtaacttaccttcgttcgttcccgtttacc

SEQ ID NO: 273141 - DNA, 695 bp, Homo sapiens
  misc_feature: GYAE6OF01EX6CN.43.33.C11.1.454.CMB.1.raw
  modified_base (561)..(561): a, c, t, g, unknown or other
  misc_feature (561)..(561): n is a, c, g, or t
tcagtgtgagtagtcacgaccggtgctcgatttagagtgagctcgttgggtttgggggcagaagtctctctcagtcaggacacagcatggacatgagggtccctgctcagctcctgggctcctgctgctctcggcctcccagcagtacttaccagatgtgacactaccagatcgaccacgtcgccacgtcccttcctgtctgacgaaggttggtagggaagacgtacggtacgtttaccgttaccgtttttcgggccggggtcggtacggtccggacctagttcgtacgtacgtttggttcggtcgttggtactcggtcggtacggacgaccggacggcctaacctcctactaacttcgttagtacttaccgttaccgttactacgttcgtcgttcgtcgtaccggtacgggttccgggtacctaccggttcggtacgtacggtcgaccgtacggtctacgtacgtaacgtacgttacgtttacttttcgtctacgttcctagtacgttacgtcgttactacgtcgtactcgggacgacggctaactcttacgttaccttntacgtactaactccgtacttcgtacccttacccttaccgttacgtacgtttcggaccggaaccgggtaacttacggtacgaacttaacgtacacggttaacgacgttcgggtactaccacggtcctacgttacg

SEQ ID NO: 273142 - DNA, 643 bp, Homo sapiens
  misc_feature: GYAE6OF01EVXM0.43.33.C11.1.454.CMB.1.raw
tcagtgtgagtagtcacgaccggtgctcgatttagagtgagctcgttgggggtttgggggaagtctctctcagtcaggacacagcatggacatgaggtccctgctcagctcctgggactcctgctgctctggctcccagattccacgatgtgacatccagatgacccagtcgccagcctcctgtctgcaagtgtggagacagagtactaccctttttgccggcgagtcggcctatgacgactgttggcctggtatcgcgtgagaccagggaccaaccgtcctacaacttctgataataccgttcatacgtctgttcgctacggttcgggtccctacgtcgttcagtcggacaacggtctacgtgacgaactacgtacttttctctacgtctactcgacgttgtactactacgtcgtagaaccgacggtctactaaagttcgttaacctttcgtacgtactaaacacttaactcgtacccgtccctaccccccttaataaacggttttccggaccgtaacgggggaacccttaaagggttaccggaaaacccgtagttaaaccgtaaccgtaccggtaaacgttcggttcgggacccttacggaaccctacccgtaaagttcccgttacgtccgtttaaccccg

SEQ ID NO: 273143 - DNA, 713 bp, Homo sapiens
  misc_feature: GYAE6OF01BV4BS.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatcgacccagtcgccacgccctccctgtctgcgaagtggtgggagacagtacgtccttacccgtttttggccgggcgaggtccggcctagttcgaccgtaacgttggtttacggtccgttggtacgtccgcggttggacgaccgacgggccaaccgtcctacaacttcagtacttactacccgttcgattcgtcgttagttcgcgtacggtttccggggtccctaccgttcggttcgtaggtcggacctaacgggtcctcgtcggaacgaccgtaaggtttactttttccgtccttccggttactaacgtccgtttaacgttcggttaccttaaacgtcgttcccgtacgggaccgggaaccggtcgtaactaacgtttccgtttaactttcctacggtaacctaactacttaccgtcgttaccccttccccttacccctaacgttaaccgtttccggacggtaccgggtaaaccgtacggttacaaacacctttaaccaaaccgttccgtaaacgttccgggtactaccgtcgtaccgtacccgttac

SEQ ID NO: 273144 - DNA, 689 bp, Homo sapiens
  misc_feature: GYAE6OF01DAK3P.43.33.C11.1.454.CMB.1.raw
  modified_base (201)..(201): a, c, t, g, unknown or other
  misc_feature (201)..(201): n is a, c, g, or t
tcagtgtgagtagtcacgaccggtgctcgatttagagtgagctcgttgggtttgggggcagaagtctctctcagtcaggacacagcatggacatgagggtccctgctcagctcctggactcctgctgctctgctcccagacttccagatgtgacatccagatgacccagtcgccacgcctccctgtctgcaagtgtggganacagtagttcctaccgtttttgccggcggacgtcggccagttgacgtactgtttcgcgtgtactcgcgtacgacgaaccgaggaccaaccgtcctactaacttcgtcgtaattacgttaccgttcaacgttcgtcttgttcgcgtacggttcgggtaccctccgttccggtagtacggtacggcctaaaccgggtcttcgtacgtacgtaccgtacgtttacttttttccaccgttcggttaccacttccgtacgtttacgaccttacgtacgttcgtacgaacggtaccgaccgtactaacgttcgttaaccgtttctaggtaacccaacgtacttccgtaccgtttacccctaccccgtttaccccctaacgtttaacggtttccccggaggttaaacccgggtaccttaaacggttacggtaactaacgttaccgaaacttaccgaacgttcgtacggtacttaccgactacctcgttccgttcg

SEQ ID NO: 273145 - DNA, 791 bp, Homo sapiens
  misc_feature: GYAE6OF01COC32.43.33.C11.1.454.CMB.1.raw
  modified_base (206)..(206): a, c, t, g, unknown or other
  misc_feature (206)..(206): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagacttccagatgtgacatccagatcgacccagtccgccacgccctcctgtctgctaagtgtggganacgagtacgttccttacccgtttttggccgggtcgtacggtccggcctagttacgacgtacgttggtttcggcctaggtactcggacgtacggaacgaccgacgggacctaacccgttccgtacctaactttcgtacggtaacttaacgttacccgttcacgttccgtcgttcgttcgtaccgttaccggttccgggtaccccctaccggtttacgggttacgtacgggtcggaccgtaacggtcctcggtacgacgtacgttaggtttacctttttccgacctttacgtacctacgttaccgtacggtttcgttacctaacgtcgttaccgtacggaccggtacggtacgtaccgtaagtttccgttaccgttacgtacgttaacctaacgttaaccttccgtaccccgttacccctttacccccttaacccccgttaacgtttaaccggtttacccgggaaccggtaaccggggtaaaccttacggttaccgaaaccttaccgtaaccgttaaacgttaccggtaaacggttcggtacccggttacgttaaccggtcccttaaccgtcgtttccgtttacccg

SEQ ID NO: 273146 - DNA, 667 bp, Homo sapiens
  misc_feature: GYAE6OF01AYPLX.43.33.C11.1.454.CMB.1.raw
  modified_base (114)..(114): a, c, t, g, unknown or other
  misc_feature (114)..(114): n is a, c, g, or t
  modified_base (302)..(302): a, c, t, g, unknown or other
  misc_feature (302)..(302): n is a, c, g, or t
tcagtgtgagtagtcacgaccggtgctcgatttagagtgagctcgttgggtttgggggcagaagtctctctcagtcaggacacagcatggacatgaggtccctgctcagctccngggactcctgctgctctggctcccagattccagatgtgacatccagatgaccagtcgcagcctcctgtctgcaagtgtggacgacagacgtctaccgtttttggccgggcgacggtccggcctagttgacgtacgtggtttgccgtggtatcgcgtgacgaccgagggccacccgtcctctaacttcngtactactccgttctactcgacttgttcgcgtacggttccgggtccctaccgttcggttcacggtcggaccgtaacggtctacgtggacgtacgtacggtttaactttttcctccgttacgtactacgttccgtaacgttcggtaccttaaaccgtcgttccgtacggaaccggtaccggaccgtactaaacgttcgtaaccgttttcgagttaccaacgtcttacgtcccgtaccctttccccctaaccccttagttaacgtttccgggtaaccgaacgggttaacccgttacgtaacgtacctagtaactaacgtaccggtaacgttggtccggtactacgacccgttactgtttccgttacg

SEQ ID NO: 273147 - DNA, 795 bp, Homo sapiens
  misc_feature: GYAE6OF01DSV84.43.33.C11.1.454.CMB.1.raw
tcagtgtgagtagtcacgaccggtgctcgatttagagtgagctcgttgggtttgggggcagaagtctctctcagtcaggacacagcatggacatgacgggtccctgctcagctccgtggactcctgctgctctcggcctcccagcagtacttccagatgtgacactaccagactacgacccagtccgcctacgccctccgtgtctgacgtaaggtggtggagacgtacgtacgttccttaccgtttttcgggccgggtacggtcgtccggtacctacgttacggtaccgtacggttcgttcgggtacgttcggtcgtacggtcggtacggacggaaccggtacggaccctaccttccgttaacctaacctttcgttacgtaacttaccgttaaccgtttacgtacgttccgttcgtttcggttaccggtacggttacccggggtttacccgggttaccccgttacccgggtttaccgggttacgtaccgggtacggacccggtaaccggtcgttacgtagaacgttacgttacgttttacttttccgtcgttaccgtcttaacgtacgttcggtacttacctaggacgttcaaccggcgggaaccgttagacgttactttcggttacttcgaacgtttaccaaacttccgttaccgtcccgttacccccttcccttaaccccgtttaggttaacccgttacgggtaccgggaaacggttacttaaacggtacctaaattaccggaactttaaccggaaccgtcgtttagggccctaccaccgtcctaacggtttc

SEQ ID NO: 273148 - DNA, 745 bp, Homo sapiens
  misc_feature: GYAE6OF01BAHP7.43.33.C11.1.454.CMB.1.raw
  modified_base (733)..(733): a, c, t, g, unknown or other
  misc_feature (733)..(733): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagacttccagatgtgacatccagatcgacccagtccgccacgccctcctgtctcgcaagtggtagggagaccagtacgttaccgttcccgtttttcggccgggtcgacggtcccggaccctagttcgtaccgtacgttggtttcggccgttggtactcggcgtcgaacgaccgacgggcctaacctcctactaaccgttctacgtacttactaccgttcactcgtacttgtcgtaccgtaccgggttccgggtccctaccggtttcggtacgtaacggtcggtaaccgtaccggtccgttcgtaacgtaacggtactttaacgtttcctttttaccgtcttaggtacctacgttccgtaacgttcttacgtacgttacgtcgtacgggaaccgtacggtacgtaacgttacgttacgttaccgtttactaaccggttaactaaccttcctaccgttaccccggttccccttacccccgttaacccgtttacgttaaccggtttaccggtacccggtaacggtaacccgttaagtaaccgtaagccgttaacgtacgtaacgtacgttccggactacgtccgtaccttaacctnttcccgtttacg

SEQ ID NO: 273149 - DNA, 894 bp, Homo sapiens
  misc_feature: GYAE6OF01DPHT9.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagcctcctgggactcctgctgctctggcctccagtacttccagatgtgacatccagactcgacccagtccgccacgtccctccctgtccgtgacgtaaggttggagggacgacgtaacggtacgtttcccgtttaccccggtttttcgggacccggggtaccgtacggttccccggaccccgttagttacggtaaccggttacgttttcgggttttccgggtacccgtttacgggttaacgttccgggtacggttacggtaaccggaaccccggtaaccggggtaaccccttaaaccccgttaccccgtttaacccgttaaaccgttttccgtaacgttaaaccgtttaaccggtttaaccccgtttacgttaaccgttccggtttacttcgggttttccggacccgtttaccggggttttcccgggtacccccttaccggtttccgggtttacgacggtaccgggaccgtaaaccggtcgtacggtaacgacgtaacttacggtttactttttccgcgttcgtacttacgtcctacggttcgtactacgtcgtacgtacggacgtacgacgtaactagttacgttaccgttatacgttaacctaacgtacctttaccgtacccgttacccccttaccccgttaaccccgtttacgttaaccgggttttccggaacccggtaacgggtaaccttaacgggtacctaaacggtaccttaaccgtaacgtttaccggtaaccgttggtacccggtcttaaccggaccttacctcgttaccgtttaccg

SEQ ID NO: 273150 - DNA, 860 bp, Homo sapiens
  misc_feature: GYAE6OF01C7G1Z.43.33.C11.1.454.CMB.1.raw
tcagtgtgagtagtcacgaccggtgctcgatttagagtgagctcgttgggtttgggggcagaagtctctctcagtcaggacacagcatggacatgaggtccctgctcagctcctgggactcctgctgctctggctcccagtattccagatgtgacatccagatcgacccagtccgaccacgccctcctgtctgactaagtgtagggagacgagtacgttaccttacccgttttcggccgggtcgacggtccggacctacgttcgaccgtacgttggttacggccttggtactcggcgttacgacgaccgacggacctaacccttccgtctaaaccttcgtacgtaacttaccgttaccggttacaacgttccgtaccgtttacggttcggtaccggttacccgggtttaccggggtaccccttaacccggtttccggttaaccggtacgggttacccggtaaccggtaaaccgggtccgttaccggtacggtaacgtaccgttaacggtttacttttttacccgcctttaccggtaccttaacgttaccgttaccggttacggttacccttaacgtacgtttaacgtaccggtaaccgggtaaccggtacggttacccttaaagggttcctttaaacgtttccgtttaaggtaccctaaacttaaccggttacttaccccgttacccgttacccccttaaccccctttaacggtttaaacccgtttccccggggtaacggttaaacccgggtacgttaaaaccgggttaacctaaacgtaaccgttaacgaaaccggtttacgtaaccgttccggaaccgttacgtaccgtaaccaccgttaacgttcggtttaaccccg

SEQ ID NO: 273151 - DNA, 721 bp, Homo sapiens
  misc_feature: GYAE6OF01BDDFR.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagcagattccagatgtgacatccagatcgacccagtcgccagccctccctgtctgcgtaagtggtagggagacgtagacgttccttacccgtttttggcccgggtcgtacgtccggccctagttcgacgtacgtttcggttcggtccgttggttacgtcggtcgtaggacggaccgacggtaccaacccttcccgtactaacctttctggtaacttaccttaccgttcaacgttccgttacgttcgttcgccgttaccgggttccgggtacccctaccggttcggttacgtagtcggacgtaaccggcttacgagtacgaacttacgttactttttccgtacgttctactaactccgtacgttcggtactacgtacgttaccgtacggaaccgcggtacgtacgtaacggttccttacgttccttacgtaaccgtaacctacggtaccttccgtaccccttccccgtaccccctacgtttaacggttcccggtaacgtaccggggtaaacttacggtacaaacgttactcgtaaaccgtccgttaaacgtggttacccgagttaccgacctaccgttaccg

SEQ ID NO: 273152 - DNA, 879 bp, Homo sapiens
  misc_feature: GYAE6OF01DYLNM.43.33.C11.1.454.CMB.1.raw
  modified_base (132)..(132): a, c, t, g, unknown or other
  misc_feature (132)..(132): n is a, c, g, or t
  modified_base (175)..(175): a, c, t, g, unknown or other
  misc_feature (175)..(175): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctcnggcctccagattccagatgtgacatccagatcgacccagtccnccgacgccctccctgtctgaccgtaaaggtggtaggggaacgaaccgaggtacgtttacccgtttaccccgttttttacgggcccggggtacgtacgtacccgggacccttagttacggtacccgtacgtttgggtttccggtaccgttacgggttacgttcggacggtacggaacggaacccgtaacggggtacctaaaccccgttaccttaccgtaaacctttacgtacgtaaacttaccgttaccgtttaccgaacgtttccgtcgtttaggttcggtaacccgggttcccgggttttaccggggtaaccccctacgtttccggggttacgtacggggtaccggtaaccgtacccggtactttcgacggtaacgacctttaagtttaaccgtttttcctacgttaccgttactaccgtttaacctccggttagttaacccttaacgtacggttaccggtaacggtaacggaccggtacgtaaccgtaacttttcggttaacctttcggttaacctaaccgtaaacccgttcgttaaccggttcccctaccccttaacccccgtttaaccccgttaaccgtttaacgttcccgggtaaccggtaaccgggtaaccgttaaacgttacaaacgtacctaacgtaacggttccggtaaacgttacgtacggtacctaccggtaaactacccttattcggttacc

SEQ ID NO: 273153 - DNA, 834 bp, Homo sapiens
  misc_feature: GYAE6OF01AM69O.43.33.C11.1.454.CMB.1.raw
  modified_base (436)..(436): a, c, t, g, unknown or other
  misc_feature (436)..(436): n is a, c, g, or t
tcagtgtgagtagtcacgaccggtgctcgatttagagtgagctcgttgggtttgggggcgagaagtctctctcagtcaggacacagcatggacatgacgggtccctgctcagctcctgggactcctgctgctctggcctcccagtacttccagtatgtagacactccaggactcggacccacgtccgccacgtccctccctggtcctagaccgtaagtggtgggaacgacgagtacgttcccttacccggttttcggacccgggtcgtaggttccggtacccgtacgttacggacggttaccgtttcggtttcggtccgttacgggttacgttccggacggttacggaaccggtacccggacgggtacccctaaacccgtccccttacgttaaaccttccgttacgtaacttaccgttaccgttaccacttccgtnttacggttcgacccggtttaacggttccccggggttacccaccggtttccgggttaccgtacggtcggaccgtaacggtctcggtaaggtactaccgttgtttaccttttcctcggtccttcgtagttaccgtccgttacggtccttaacttcggttaccgaccggtaaccgggtccgtaccttaacgttaaccgtttcgttaaccgttgtttaaccaacgtacctttaacgtcccggttacctaccccttacccccgtttaccccgtaaacgttttcccggttaccgggtaaacccgggtagggttaacccgtaaacgttttaccgaaacttacgtaacgttaccctaaggtcccgttagtacgtccggtactacccgtaacttcgtaaccttccgg

SEQ ID NO: 273154 - DNA, 691 bp, Homo sapiens
  misc_feature: GYAE6OF01B8X7X.43.33.C11.1.454.CMB.1.raw
  modified_base (682)..(682): a, c, t, g, unknown or other
  misc_feature (682)..(682): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtccgccagccctccctgtctgcaaggtgtgggagacagacgtccttacccgtttttggccgggcgacggtccggccctagttcgacgtacttggtttcggccgtggtacgtcggcgtgacgaccgagggacctaacccgtcctacgtaacctttcgtagtacttaaccgttacccgttctacgttcggtacttggttcgaccgttacggttccggggtaccccttaacccgttcggttcgtacggtcggaccgtaaccggtccttacgtacggacgtaacgtacgtttaactttttccgtaccttccggttctacgttcctacgttcggtactaccgtacgttcgtacggaccggtacggaccgtacgtaagttcgttacttcgtacgtacctaacgtccttactccgtcccttacccctacccccttaagtaccgtttccgaacggtacgggtaacctagtacgaactataacacgtacgtacgtcggtcgtacctacgactacgtatcgttnttcttaccg

SEQ ID NO: 273155 - DNA, 712 bp, Homo sapiens
  misc_feature: GYAE6OF01DZU6M.43.33.C11.1.454.CMB.1.raw
  modified_base (209)..(209): a, c, t, g, unknown or other
  misc_feature (209)..(209): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagacttccagatgtgacatccagatcgacccagtccgccacgcccttccctgtctgcaagtggtgggganacagtacgtccttacccgtttttggccgggtcgacgtccggccctagttgacgtacgttggtttcggccgttggtatcggcgtggacgaccgaggccaacccttcctctaactttctagtacttaccttaccgttcacttccgtacttcggttcgtccgtacgggtttcgggtcccctaccgttcgggttctaggtcggtaccaacggttctcgtagacgtactagttactttttcgtcgttccgtactacgttcctacgttggttacctaacgtacgtacgtacggaccggaccggtacgtactaacgttcttaccgtttacacgtaaccgtaacctcgttaactacccggttacccttacccctttacccccttaaacgttcggttttacccgggaacggtaacccgggtaaaccctaacgggttacgaaaaccgtacgttaaccaaacgttacggaaccgttggacggtaccgttaccgaactaacccgttgtcgttacg

SEQ ID NO: 273156 - DNA, 748 bp, Homo sapiens
  misc_feature: GYAE6OF01BS039.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagacttccagatgtgacatccagatcgacccagtcgccacgtccctccgtgtctgacgaagttggtgggagacgagtacgtaccgttacccgtttttcggccgggtacgtacggtccggtaccctagttcgaccgtaacgttcgggttttacggcccgttagggttacgtccggtaccggttacggaacggtaacccgacggggtacctaaacccccgttccgttaccgtaaccctttcgttacgtaacttaaccgtttacccgttacgtacgttccgtcgttaggtttaccgaccgttaccgggtttccggggtacccccttaaccggttccggttacgacggttcggaccgtaaccggtccttacgtaggtaactacgtagttaactttttccgtacgttcgttactacgttccgtaacgttcggttacctacgtacgtcgtacggaccggtacggctaacgacgtttacgtcgtttcacgtaccgaactctacgtccgtaccccttaccctaccccgttattacgttccggacgtaacgggtacctagtaactacgtacttaacacgttacgacgtggtacgtctacgaccacgtcgttgttaccg

SEQ ID NO: 273157 - DNA, 764 bp, Homo sapiens
  misc_feature: GYAE6OF01AD0IX.43.33.C11.1.454.CMB.1.raw
tcagtgtgagtagtcacgaccggtgctcgatttagagtgagctcgttgggtttgggggaagtctctctcagtcaggacacagcatggacatgagggtcctgctcagctcctgggactcctgctgctctggctccagtattccagatgtgacatccagatcgacccagtccgccacgcctcctgtctgacaaggtggtagggagacgagtacgttccttacccgtttttcggccgggtcgtacggtccggaccctagttacgaccgttacgttcggtttacggccgttaggtactcggtacggtacggtacgaccggacgggacctaccccttaccgtacctaaccgtttcgtagtaaccttacgttacccgttactacgttccgtcgtttcggtacggtccggttaaccggggttcccggggttaccctaccggtttaccgggttacgtaacgggtcggtaccgtaaccggtcgttaccggtacggtaacgttaacgtacgttttaacctttttccgaccgtttcgtactacgttaccgtacggttacgttacctacgttacggtacgtacgggaccgtacgtacgtacgttattacggtccttacgtcgaacctaactaccgttacgcccttacccctacccctaccgttacgttaacgttccggtaccggaacgggtaaccttacgtacggtacctacgttaaccgtcgtaggtacgtcggtacgtactccgtaactacttccgttctacgttccttacccg

SEQ ID NO: 273158 - DNA, 646 bp, Homo sapiens
  misc_feature: GYAE6OF01CIGI5.43.33.C11.1.454.CMB.1.raw
  modified_base (181)..(181): a, c, t, g, unknown or other
  misc_feature (181)..(181): n is a, c, g, or t
  modified_base (358)..(358): a, c, t, g, unknown or other
  misc_feature (358)..(358): n is a, c, g, or t
  modified_base (622)..(622): a, c, t, g, unknown or other
  misc_feature (622)..(622): n is a, c, g, or t
  modified_base (639)..(639): a, c, t, g, unknown or other
  misc_feature (639)..(639): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagtacttccagatgtgacatccagatcgacccagtccgaccncgccctcctgtctgctaaggtggtagggagacgagtacgttacttacccgttttcggaccggtcgtacggttccgcctagttacgacgtacgttcggttcggccgttgtacgtccggtacgtggaacgccgacggactaaccctccgtactaccgttctataacgtacttaccgttnacgttcgcgttagttcgacgttaccggtcggtaccccgtcgttcggttacacggtcgtacgtaacggtcctcgaggtacgtaacgtgtttacttttctcgttctctactactcgttacgtactacgtacgctaggaccggtacgcgtactaacgttctacgttctacgtaacctacgtaactaccgtccctacccgtcccttaccccgtaacttcggttaccgacggtacggtaactagtacactactataaccgacgttacgngtcgacgttcaccactntcgtacc

SEQ ID NO: 273159 - DNA, 811 bp, Homo sapiens
  misc_feature: GYAE6OF01D8KEY.43.33.C11.1.454.CMB.1.raw
tcagtgtgagtagtcacgaccggtgctcgatttagagtgagctcgttggggtttgggggaagtctctctcagtcaggacacagcatggacatgagggtccctgctcagctcctgggactcctgctgctctggctcccagattccagatgtgacatccagatcgacccagtcgccacgtccctccctgtctgacaaggtggtgggagacagtacgttccttacccgtttttcggccgggtacgtacggtccggcctagttcgacgtacgttggtttcggtccgttggtacgtcggtcgtagacggaccgacgggacctaacccgtcctactaacttcgtacgtacttacttaccgttcacgttcgtacttcgttcgtcgtaccggtttccggggtacccctaccggttccggttacgaggtacggaccgtaacggtcctacgtaggaacgtactacgtttactttttccgtacgttcgtacgtacttaccgtaccgtttacggtaccttaacggtacggttcccgtacgggtaaccggtaccgggtacctacgttaaacgtttcgtttacccgtttacgttaccgttaacctaaccgtaccttacgtccccgttcccccttacccccgtttaacccccccgttaactttaaaccgggttttcccgggtaaccggtaacccggggttaaaccgttaaccgttaacgtaaccgttaaaccgttaccgtaaaacgtttacccgtacggttacgggtaccggtcttaacccgtacccttaaccttacgtttacccggttcgtttacccttaacccg

SEQ ID NO: 273160 - DNA, 765 bp, Homo sapiens
  misc_feature: GYAE6OF01BAIFB.43.33.C11.1.454.CMB.1.raw
tcagtgtgagtagtcacgaccggtgctcgatttagagtgagctcgttggggtttgggggcagaagtctctctcagtcaggacacagcatggacatgagggtccctgctcagctcctcgggactcctgctgctctcggcctcccagtacttccagatgtgactactccagactcgacccagtcgccacgtcctccgtcgtctgacgaaggtggtgggagacagtacgttccttaccgttttcggccgggtcggacggtccggtcctagttcgacgtacttggttcggtcgtggtactcggcgtcgacgaccgacggacctaccgtcctcgtaacttcgtagtacttacgtaccgtctactcgtcttcgtgtacggtacggttccgggtacccgtccgttcggttcgacggtcggaccgtacggtctacgtagaacgtacgttacgttacttttcgttacgttccgtactacgttccgtacgttcggtacctacgtaacggttcgaacggaccggtccgggtacgtacgttaaccgtttacgttactttccgtaccgtaacctaaaccgttacgttcgtcccgttaccccgttacccctttacccccgttaacgttaaccggtttaccgggtaaccgggtaccgggtaaaccgtaaacggtttaaccgaaaccgttaacccgtaacggtaaaccgttaccgggtacgtttaccgggtacggttaccgtaaccggtacccgtaaccctttacggttcgtttaaccccg

SEQ ID NO: 273161 - DNA, 810 bp, Homo sapiens
  misc_feature: GYAE6OF01DX5DY.43.33.C11.1.454.CMB.1.raw
tcagtgtgagtagtcacgaccggtgctcgatttagagtgagctcgttggggtttgggggcagaagtctctctcagtcaggacacagcatggacatggacgggtccctgctcagcctccgtggacctcctgctgctcgtcggcctccagtactccagtatgtagacactaccagtactccgacccgagtccgacctccgtcccttccgtgttcgcgtacgtaaggtgggtagggaacgacgtaaggtaccgtttacccgtttacccggttttcggggcccgggtacggtacgggtcccgaccgtagttaccggaaccgtcgtttcggttcggtccgtaggttacgtccggcggtacggacggaccggacggacctaaccctcgtactacgttctacgtaacttccgttacctctaactcgtcgttgtaccggtacggtacccgggttccggtacccctacggttacggtcgacggtaccggaacgtacgtcgtaacgtagaccgtacgtttagtttaccttttcgaccgttcgtactaacgtcttacgttacggtacttaccgtggttcccgacgggaaccgtaccggacttacggtaactttaccggttacctttcgtaaccgttaacaaccggttaccgttacccgtacccccgtttacccctaacccccgttaccccgttaaaggttcccggtttaaccggaaaccgggacgggttaaacccttggtaaacccgacgttaaccgtacgtaacgttccggtaaccgtgggtcccttaagcccgtaacccgtacttcgtttccgtacccg

SEQ ID NO: 273162 - DNA, 843 bp, Homo sapiens
  misc_feature: GYAE6OF01BA4F7.43.33.C11.1.454.CMB.1.raw
  modified_base (157)..(157): a, c, t, g, unknown or other
  misc_feature (157)..(157): n is a, c, g, or t
  modified_base (391)..(391): a, c, t, g, unknown or other
  misc_feature (391)..(391): n is a, c, g, or t
tcagtgtgagtagtcacgaccggtgctcgatttagagtgagctcgttggggtttgggggtcgagaagtctctctcagtcaggacacagcatggacatgagggtcccgtcgctcacgctccgtgggacgtcctgctgctctcggctcccagacttccngatgtgactatcagatcgacccagtcgccacgcctccctgtctgacaagtggtgggagacagacgttccttacccgtttttacggccgggcggtaccggtccggaccctagttacggaccgtacgttcggtttcgggtccgttagggtacgtcggtacggtacgacggaccggtacggggaccctaacccttccgtacctaaccgttctacgtacgttaacgttcccccgttanacgttcgtcgttcgttcgtacgttaccgggttcccggtcccgtacgttcggtacgtgggtaccggtactacggtcctacgtagggtaacctacggttgttaaccgttttcttcccgtacgtttacgtacttaccgtccggtagtttaccctaacgtacgttacggtaccggaaaccgggtcccggtaacgttaccgttaaaccggtacgtttacccgtttccgttaacgttaaccccgttaaacgtacccgtttaacgttcccccggtaacccctttacccccccgttaaaccccgtttacgtttaacccggttaccgggttaaccccgggttaaccgggtaaacccgtttaagtaacccgttaaacgaccttaacggtaaacgttccggtaaccttaggggtacccgttaccggacccgtaaaccgttaacccgtaggtttcccttaccgg

SEQ ID NO: 273163 - DNA, 117 bp, Homo sapiens
  misc_feature: GYAE6OF01AQ4N5.43.33.C11.1.454.CMB.1.raw
  modified_base (115)..(117): a, c, t, g, unknown or other
  misc_feature (115)..(117): n is a, c, g, or t
tcagtgtgagtagtcacgaccggtgctcgatttagagtgagctcggttgggtttgggggcagaagtctctctcagtcaggacacagcatggacatgacgggtccctgctcagccnnn

SEQ ID NO: 273164 - DNA, 725 bp, Homo sapiens
  misc_feature: GYAE6OF01DO9CK.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagacttccagatgtgacatccagatgacccagtcgccacgtccctccctgtctgcaaggtggtgggagacagtacgttccttacccgtttttcggccgggcgtacgtccggacctagtgtacgtacgttggtttcggcctggtactcgcgtagacgaccgacgggacctacctcctactaacttctagtactactaccgttcagtcgtctgtcgcgtacggttccgggtaccctaccgttcggtcgtacggtcggacgtacggtctcgtagacgtactagtttacttttcttacgtcgtactactcctacgtcgttacctacgtcgttacgtcggaccggtaccggtacgtacctaaagttcccgttacttcgttacgttaacctaactaacctttacgtaccccgttaccctttaccccccttaaccccccgttaacgtttaccgttttacccgggaccggttaaacccggggttaacccgtaacggttaaccgtaaacgtaccgttaaacgaaacggttaccccggtaaacgttcgggtaccggttcctaccggtaccctaaacccgtccgtttccgttaccg

SEQ ID NO: 273165 - DNA, 737 bp, Homo sapiens
  misc_feature: GYAE6OF01C5UTZ.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctcggcctcccagacttccagatgtgacatccagatacgacccagtcgccacgtccctcctgtctgactaaggtggtagggagacgagtacgttccgttaccgttttggccgggtccgtacggtccggtaccctagttacgtaccgtacgttggtttcgggccgttcggttacgtccggacgttaggaccgaaccggacgggaccctaacccttccctacttaaccttcgtacgtaacttaaccgttaccgtttactacgttaccgtcgttacggttccggtaccgggttacccggggttcccggggtacccccttaccggtttccgggttaccgtagggtccgggtaaccgtaacgggtccttacgtacgggacgtaacgtacgtttactttttcctacgtttcgtaccttacgtccgtaacgttcggtaacctacgtacgtcgtacggaccggacggacgtactaagtcttacgttctacgtactaacgtacttcgtaccgtcccctacccgtaccccttagttaacccgttcggacggtaaccggtactacgtacgaactctacaacgttacgacgttgacgtctagcccaacgtgtcttaccg

SEQ ID NO: 273166 - DNA, 619 bp, Homo sapiens
  misc_feature: GYAE6OF01BIHQG.43.33.C11.1.454.CMB.1.raw
  modified_base (500)..(500): a, c, t, g, unknown or other
  misc_feature (500)..(500): n is a, c, g, or t
tcagtgtgagtagtcacgaccggtgctcgatttagagtgagctcgttggggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagacgtctacccgtttttgccgggcgaggtcggcccattgacgtactgtttcggccttggtatcggcgttaggacgacgtagggcctaaacctcctacaacttctgattactaccgttcatcgtctgtgcgtacggttcgggtccccaccgttcggttacaggtcggaccaacgggtcttcgtgtaacgacgtaacgttattttttcctcgttcgttacacttccgtactttggtacctaatacggttcctacggtaaccggtaccggcgtacctaattcgttactttccgtntaccaaactactatccgtcccttccctacccctactaaccggtttcgacgtacgggaaaccttaggtacgtaactataacagtaacgacttaggtacggtaccgtctccgaaccttacg

SEQ ID NO: 273167 - DNA, 596 bp, Homo sapiens
  misc_feature: GYAE6OF01BMQMK.43.33.C11.1.454.CMB.1.raw
  modified_base (202)..(202): a, c, t, g, unknown or other
  misc_feature (202)..(202): n is a, c, g, or t
  modified_base (399)..(399): a, c, t, g, unknown or other
  misc_feature (399)..(399): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatcgacccagtcgccagcctccctgtctgcaagtgtggganacagagtctaccctttttcggccgggcgagtccggccagttcgacgacttgtttggcctggtatcggcgtgagaccgagggcaaccctcctcaacttctgacttactaccgttcacttcgcttgttcgccgtacggttcgggtcccctaccgttcggttcaggtcggcgaacgtctcgcgagactgttacttttccncttacgtctacttcctacgttggtacctatacgttcgtaggaccggacggcgtactaacgtcgttaccttcgtgtaacctaacactactccgtccctacccttacccctacgtacgtttccgcggaacgggtacctagtaccgaactactacgtaactacgtacgtgtacgtcgtacgactacctagtccttaccgg

SEQ ID NO: 273168 - DNA, 733 bp, Homo sapiens
  misc_feature: GYAE6OF01BMIC0.43.33.C11.1.454.CMB.1.raw
  modified_base (510)..(510): a, c, t, g, unknown or other
  misc_feature (510)..(510): n is a, c, g, or t
tcagtgtgagtagtcacgaccggtgctcgatttagagtgagctcggttgggtttgggggcagaagtctctctcagtcaggacacagcatggacatgacgggtccctgctcagctcctgggctcctgctgctctcgcctccagcagacttccagtatgtgacactccagactcgacccgacgtccgccacgtccctcctcgtctgacgtagtggtggagacagtacgttccgttaccgttttcggcggtcggtacgtccgtacctagtcggtacttacgttcggtttacggccgttgggtactcgtaccggtggaaccgtaccggacggtaccctaccgttcccttacgtaccttacgtacggtaactttaccgttacccgttataccgttccgttcgttacggtccgtccggttaccgggttcccggtaccccttaccggttcgttaccgaggtcggacgtaccggtctcgtaggtaacgtacttacgttttcgtttcctctttcgtacncgttcgtccgttgttaccagttacgttaccgcgtaccgaaccggtcgaacttacgtttacgttacttacgtactaacctaaacgttcaccgttcccctaaccccgtttccctacccggttaaacctttcggtaaccggtacggtaaaccggttacaaaccgggttctaacgtacggttacaaaccgttccggttaatcggtaacgcctacgtacccgctttcg

SEQ ID NO: 273169 - DNA, 768 bp, Homo sapiens
  misc_feature: GYAE6OF01AONMF.43.33.C11.1.454.CMB.1.raw
tcagtgtgagtagtcacgaccggtgctcgatttagagtgagctcgttgggtttggggcagaagtctctctcagtcaggacacagcatggacatgaggtccctgctcagctcctggactcctgctgctctggctcccagacttccagactgtagacatccagactcgacccgagtcgaccacgcccgttcctggtcctcgccgtaaagtgggtacgggaacgacgaggtacgttccttaacccgtttttggccgggtcgtaacggtcccgggacctaggttcgacgtacgtaggtttcggtaccttggtacgtcgtcggtacgaacgaccgagggaccaacccgttcctaccgtaaactttcgtacgtacgttactaccggttctaccgttccgtacgttcgttacggtccgttacgggtttaccggtccctaaccggttccggttcgaacggtcggaccgtaccgggtacctacggtacgaacgtacgttagttacttttaccgtcgttccgtactacgtacctacgtcggtactaacgtcgttcgtacggtacgaccgtacgtacgtaacgttaccgttaaccgtttcgtaccgttaacgtaaccgtacccttaacgttcccgtaccccttaccccttaacccccgttaattaacccggttttacggaccggttaaaccggggtaacctaacggtactaaaccgtgtaacctaacggtccgtaaacgtcggtaacgtcccgttacgaccgtacctaacgtctttacg

SEQ ID NO: 273170 - DNA, 692 bp, Homo sapiens
  misc_feature: GYAE6OF01A8T7O.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatcgacccagtcgccagcctccctgtctcgcaagtgtgggagacaggtacgttccgtacccttttttcggccgggtcgacggttccgggccctagttgacgtacttgtttcggcctggtactcgcgtcggtacgaccgtagggcctaaccctcctacctaacctttcgacgtattacgtaccgttctagttccgcttggttcgtccgtacgggtttccggggtcccctacgttccggttacgtacggtcggaccgaaccggtcttcgtagacgtacttagtttacttttctaccgttcgtctacttcacgtttcggtaccttacgtacgttctacggtacggaaccgggcgtaactaagttcggttacccttcgttacgtaactaacctacgttacgtccgttacccctaccccgttaaccccccttaagttaaccggtttccggtacggtaaccgggtaacctacgtttacgaactacgtaaccaacgttccgtaacgtggtcgtacgtcaccgtactcgtcgttacccg

SEQ ID NO: 273171 - DNA, 783 bp, Homo sapiens
  misc_feature: GYAE6OF01A5FIP.43.33.C11.1.454.CMB.1.raw
tcagtgtgagtagtcacgaccggtgctcgatttagagtgagctcgttgggtttgggggaagtctctctcagtcaggacacagcatggacatgacggtccctgctcagcctccgtgggactcctgctgctcgtcggcctcccgagtacgttccagtatgtacgactactccagatcgacccagtccgccacgtcctccgtgtctgcgtaaggtgtaggacgacgagtacgttccgttacccgtttttcggcccgggtacgtacggtccggtacccgtacgttacggacggtaccgttcggtttacggtccgttacgggtacgtccggtacggtacggtaaccggtaacccggacgggtaccctaaaccccgtcccgtacgttaaccgtttcgtacgtaacgttaccgttacccgttctacgttccgtacgttcgtcgtccggtaccggttccggtaccctaccggttcggttaccgtaggtccggtaccgtaccggtccgtacgtacgtacgtaccgtacgtttacgttttccgtccgttaccgtctaacgtccgtacgttacggttaccgtacgtacgttacgtaccggtaccggtacggtacgtacgtaacgttcgttacgttcgtacgtacctaactaccgttacgttcccgtaccctaccccgtaccccgttaacgttacggttccggtacgtaccggtaaccgtagttacgaactacgtacgtaaccgtacgtaacgttcggacgtaccgttactacctactacttcgtcgttcgtacg

SEQ ID NO: 273172 - DNA, 658 bp, Homo sapiens
  misc_feature: GYAE6OF01CDFKQ.43.33.C11.1.454.CMB.1.raw
  modified_base (363)..(363): a, c, t, g, unknown or other
  misc_feature (363)..(363): n is a, c, g, or t
  modified_base (644)..(644): a, c, t, g, unknown or other
  misc_feature (644)..(644): n is a, c, g, or t
tcagtgtgagtagtcacgaccggtgctcgatttagagtgagctcgttgggtttgggggcagaagtctctctcagtcaggacacagcatggacatgagggtccctgctcagctcctgggacctcctgctgctctcggcctcccagtacttccagatgtagacactccagatacgacccagtccgccacgcccttcctgtctgcgtaaggtggtagggacgacagtacgttccttacccgtttttgggcccgggacgtacggtccggcctagttcggacgtacgttcggtttcggccgttggtacgtcgcgtgacggaccgacggccacctcctacctaacttcgtagtacttacgtaccgttancgtcgtcgttcgtcgtcgtaccgggttccggtcccgtaccgttcggtcacggtaccgcgacgtcgtactaggacacgttagttctttcgtacttcgtctacgtctcgttagtctactcgtacgtacgaccggtccgacgtactacgttcgttacttctacgtaaccactacgtactcccgtccccttaccccgtacccccttattaccggttccgtaacggacggtaacctaggtaacactacgtacctacgaccgtaacgttcgtacgtccgtctaaccncttccgtcttccgg

SEQ ID NO: 273173 - DNA, 691 bp, Homo sapiens
  misc_feature: GYAE6OF01CSKT7.43.33.C11.1.454.CMB.1.raw
  modified_base (206)..(206): a, c, t, g, unknown or other
  misc_feature (206)..(206): n is a, c, g, or t
  modified_base (335)..(335): a, c, t, g, unknown or other
  misc_feature (335)..(335): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggcctccagtattccagatgtgacatccagatcgacccagtcgccacgccctccctgtctgcaagtggtggganacagtacgtccttacccgtttttggccgggtacgtacgtccggacctagttgacgtacttggtttcggctggtacgtcgcgtgacgaccgacgggcctacctcctacaacttcagtatacttaccgttnactcgcttgttcgacgtacggttcgggtcccctacgttcggttacgtaggtcggacgtaaccggtcttcgtagacgtactacgtttatttttccgcttccgtactacgttccgtaacgttggttacctaacgttcggttacgtacgtacggtaccggacgtaaccgtaagtttccgtttaacctttcggttaacttacccgtaactaaccttacgttacccgacccctttcccccttacccccttaacgtttaaccgtttacggaccggtaacggggacctaaacgggttacaaacgtaacttaccgtaaacgttccgaacgttggtacgtcctacgacccacttacttcgttacg

SEQ ID NO: 273174 - DNA, 765 bp, Homo sapiens
  misc_feature: GYAE6OF01A2IG4.43.33.C11.1.454.CMB.1.raw
tcagtgtgagtagtcacgaccggtgctcgatttagagtgagctcgttggggtttgggggaagtctctctcagtcaggacacagcatggacatgaggtcctgctcagctcctgggtacttccgtgctgctcgtcggcctccgagtacttccagagtgtcgtacatccagtacgtcgacccgagtccgccacgcctccgtgtctgacgtaagtggtggtacgacagtacgtccttaccgttttcggcggcgtacggtccgcctagttacgtacgtacgttgttcggtccgttggtacgtcgcggtacggaacggaccgacgggtacctaacccttccgtaaccgtaacttcgtacggtacttacgttaccgttacgtacgttccgtcgttacgttacgtccggtacggttccggtaccctacgttacggtacgaggtacggtacgaacggtctacgtacggaacgtacgttacgtttacttttccgtacgttctacctacgttaccgtagttccgttaacgtacgttacgtacgtaacgggaaccggtcgaccgtacgttaacgtttcttaaccgttacttacgtaacctaacgtaccgtacttcccggttaaccccttcccccttaaccccggttagttaccggttaccggtaacggtaacccgggtaaccttaggtaaccgtaactaacgttaaccgaacgttacggtaacgttcggacgtacgtacgtacctaccctttagtcccgtttaagttcccgttaccg

SEQ ID NO: 273175 - DNA, 813 bp, Homo sapiens
  misc_feature: GYAE6OF01EV276.43.33.C11.1.454.CMB.1.raw
  modified_base (191)..(191): a, c, t, g, unknown or other
  misc_feature (191)..(191): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagattccagatgtgacatccagatcgacccagtcgccacgccctcctgtcngacaagtgtggagacagacgttccttacccgtttttcggccgggtcgtacgtccggaccctattcggaccgtacgttgtttcggcctaggttactcggtcgtaggacgaccgagggacctaaccctccgtacctaacttcgtagtacttacgtacccgttcacgttccgtcgttcgttcgaccgtacgggtttccgggtacccctacggttccggttacgacggttcggaccgtaaccgggtccttcgtaggtacgtaacttacggtttaactttttcctaccgttaccgttactaaccgtttaccgacgtttcgggttaacctaaccggttacggttaacttacgggaacccggtaccgggtaccgttaacgtaaacgtttcggtttaaccgtttcgttaaccggttaccttaaaccttacttaaccgttcccggtaccccctttcccccgttaacccccctttaacgttaaacccggttttccccgggaaaccggtaacgggggttaaaccccttaaagggttaacccgaaaccgttaacgttaaccgtaaacgtccccggttaaaggttccgtacgggttcccttacgtaaccctacccggttactttcccgtttaccg

SEQ ID NO: 273176 - DNA, 812 bp, Homo sapiens
  misc_feature: GYAE6OF01A2OBQ.43.33.C11.1.454.CMB.1.raw
  modified_base (212)..(212): a, c, t, g, unknown or other
  misc_feature (212)..(212): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagcagtacttccagatgtgacatccagactcgacccagtcgccacgccctcctgtctgacagtggtaggganacgagacgttccttacccggttttggccgggcgtacgtccggccctagttacgacgtacgttggttcggtccgtggtactcggacgtaggacgaccgacgggacctaacccgttcctacctaaccgtttcgagtaccttaacgttacccgttctacgtccgtcgttcggttcgtaccgttaccggggttacccgggtaccccttaccggttccggtttaccgacggtcggaaccgtaaccggtccgttacgtagaacggtaactgttttacgttttcctacgtcgttctacgtccgtaacgttcggtacctacgtacgtacgtaccggacggtccggtaccgtagttaaccgtccgttttaccgttaccgtacgttacccaaaacgttacgttaccgttacccgttacccccttacccccgttaaccccccgtttaagttacccgggttttacccgggaaccggggttaaaccccgggttaaacccgttaaaggttacccgtaaaaccgtacgttaaaccccggttaaacggttaaccggttaaaccgtttccgggtaacggttacccttaacccggtaacccctaacggtttaaccccg

SEQ ID NO: 273177 - DNA, 853 bp, Homo sapiens
  misc_feature: GYAE6OF01BLW8A.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggcctccagtacttccagatgtgacatccagatcgaccacgtccgccacgcctcctcgtctcgactaaggtggtcgggagacgagtacgtccttaccgtttttcggccgggcgtacggtccggccctagttacgacgcgttcggtttacggccgttaggtactccggtcggtagaacggacccggacggacctaaccccgtcccttacctaaaccgtttccgtacggtaacttaccgttaccgttctactcgtcgttgttcgtccggtacggtttccgggtaccctaccgttcggttacgacgggttcggaccctaacgggtcctacgtacggaaacgtcgttaactttcgtttttacctcgttaccgtctaacgttcctaacgttcgtttacccgtagtaaccgttcgtaaccggtaccggtaacccgggtaccgtaacgttaacgtttaaccggtttacccgtttaccgggttacgtaaacccgttaacccttaacgtttaacccgttaccccggtcccccctttacccctttaaccccccgttaaccggttttaacgggtttacccccgggtaacgggtaaacccgggggttaacccttaacggtttaacccggaaaaaccgttccctaaacggtaaaccgggttaaccgtacggtttacgggtccgttaacccgtacggtaccctaccgtttaacccggtcttttccgttcccttccccg

SEQ ID NO: 273178 - DNA, 713 bp, Homo sapiens
  misc_feature: GYAE6OF01EJOJS.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctccagattccagatgtgacatccagatcgacccagtccgccacgccctcctgtctgctaagtgtgggagacgagtacgttcttacccgtttttcggccgggcgtacggtccggcccgtagttcgacgtacgtttcggttcggtcccgttagggttacgtccggtacggttacggaaccggtaacccggtaacggggtacccctaaaccccgttcccccgttaaccgtaaaccttttccgtacggtaacttaccgttacccggtttcaacgttccgtcgttgttcggccgttaccggttccggggtacccctcgttcggtcaggtcgacgtaacgtctgtacggtacacgttagtttctttacctcgtacgttacacttccgtaacttcgtacctacgtcgtcgtacggacggcggactactaagttcgtacttcgtacgtaacaactgttactccgtaccccttcccttaccccgttattaccgttccggacggtaaccggtaactaacggtacaactaacgtacctaaggtacgtacgttcggacgtcacgttacccactcgtttactcgttcttacccg

SEQ ID NO: 273179 - DNA, 665 bp, Homo sapiens
  misc_feature: GYAE6OF01E0T0F.43.33.C11.1.454.CMB.1.raw
  modified_base (173)..(173): a, c, t, g, unknown or other
  misc_feature (173)..(173): n is a, c, g, or t
  modified_base (655)..(655): a, c, t, g, unknown or other
  misc_feature (655)..(655): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcnccagccctccctgtctgacaagtgtggagacagacgtctaccctttttgccggcgagtcggcctattcgacgacttgttggccttggtactcgcgtgacgacccgagggcctaaccctcctactaaccttcgtagtaacttacttaccgttcaacttcgcttggttcgtcgtacggttccgggtccccaacgttccggtttacaggttcggctaaaccggtcgtacgtagacgtaacgtattactttttccgtcttacgtactacttcctaacgttcgtacttactacgtcgtaggaacgtaccggacgtactaaacttcgttaccttcgttacgtaactaacaacgttacttccgtacccttaccccttaccccccgttaattaaccgtttaccggttaccgaacggggtaaaccctaagttaacgaacgttactaaccgtaaagtccggaacttaggacgttacgtacgacctaaacgtntcgtttaccg

SEQ ID NO: 273180 - DNA, 794 bp, Homo sapiens
  misc_feature: GYAE6OF01A23H5.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagccctcctgtctgcaagtgtgggacgacgagtacgttcctacccgtttttcggccgggcgacggtccgggtccctaagttcggacggtacttggtttccgggccgtaggttagtccggcgttacggaacgacccggtagggtcccctaaaaccgttcccttaaccgtaaaccgttttccgacggttaacgttaacgtttaaccccgtttcgtaccttaccggtcgtttacggtttacggacccgttacgggtttccgggggtaccccttaacccggttccggggtttacgtaccgggtacgggtacccgtaaaccgggtccgttcgtacgtaaacggtactacggtttaactttttccgcgttaccggttactacgtaccgtacgttaccggttactaccgtacgttaccgtacggtaaccggacgtccgacgtaagttaccgttaccgtttactacgttaccaacgttaacttcgtaccggtccccttacccgtttacccccgttaacgttaacggtttccggtacggtaaccggtaacgtacgttaaccggtaactcgtaacctacgtacgacgttccgggtacgtccgaccggtactacccgtagttccgtaccg

SEQ ID NO: 273181 - DNA, 828 bp, Homo sapiens
  misc_feature: GYAE6OF01B1YLV.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcctagcttccagatgtgacataccagagtcgacccagtccgccacgtccctcctcgtctgtacgtaaggtggtagggaagacgacgtacgttaccttacccgtttttcggccgggtcggtacggtccggcctagtcgaccgtacgttcggtttcggccgttacgggtaccgtcggtacggaccgtaccggtaccgggtaccgtaaccccttaccccgtaccgtaaccgtttaccgttacgtaaccgttaacgttaacccgtttccgttaaccgttcccggtcctttcggtttacgtaccgttaaccggggtttcccggggtacccccgttacccggttccggttaccgttacggttcgggaaccgtaaccgggtcctacgacggtaaggtaccgttaacgtttaccgtttttactcccgttacgtccttacttaccgtaacgttcgttaccgttacgtacggttccgtaacggtacggaccggccgtaaacgtcgttaaccgtttcttacgttaccgtacctaacttacgtaccttccgtaccccttacccttaacccccgttacgttaacccgtttaccgggtacccgtaacgggtaacctaacggtaacttaacgacttaaaccgtaccgttactaacgtaccggttacgccggcgtaactccgtaccgtcttacggttcctctttaccccgg

SEQ ID NO: 273182 - DNA, 781 bp, Homo sapiens
  misc_feature: GYAE6OF01A9G8X.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagccagatccagatgtgacatccagatcgacccagtccgccacgcctccctgtctgacaagtggtgggacgacgagacgtcctacccgtttttggccgggtcgacggttccggcctacgttcggaaccgtacgttgtttcggccttggttacgtccgtcggtacgacggaaccgacggggtaccaaaccccgtccgtacctaacctttccgtagtaacttacgttacccgttacgtacttccgtccgttcggttcggtaccgtaccgggttaccgggtacccccttaccggttcggttaccgacgggtttcggaccgtaacggtctacgtggtaacgtacgttacggttactttttccgtacgttccgttacgtacttacgtacgttacggttacctaacgtacggttaccgtcggaacgggtaccggtaccgtacgtaagttcgtttaccgttacttacggtacctaacgtaccgttaacgtccgttaccccttacccgttacccccgtagtttaacccggttccgggtaacgtaaccggggtaaccttaaacggtttcgaaaccttaccgttaaccgtaaacgttaccggaaacccgtttcgggtaccgtaccgttccggtaaccttaacccgtaaccgg

SEQ ID NO: 273183 - DNA, 564 bp, Homo sapiens
  misc_feature: GYAE6OF01EEMFW.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgactgtttggcctggtatcgcgtgagaccagggcaacctcctcaacttctgatactaccgttcatcgcttgttgcgtacgttcggggtccctaccgtcggttcagtcggacaaccggcctgagacgtagtactttactttctcgttcgtactacgtctacgtcgttactacgtcgtcgtacggacggcggtctaactagtacgttacgttcgtacgtaacaactactacgccctcctaccccttaccctaacttacgttcgacggtacgtaacgtagtaacgactacaacgtacgtacagtggctcgacactactgtcgttacc

SEQ ID NO: 273184 - DNA, 780 bp, Homo sapiens
  misc_feature: GYAE6OF01AOA3P.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatcgacccagtccgccagccctccctgtctgcaagtgtgggagacagacgtcctaccgtttttggccgggtcggacggtccggccctagttcggacgtacgttggtttcggccgttggttacgtccggcggttcggtaacggaacccggacggggtacccctaaccccttcccgttacctaaaacctttcgtaagtacttaaccgttacccgtttaccacgtttaccggtcgtttaggttaccggtccgttaaccgggtttcccgggggttaccccctaacccggtttccggggtttaccgaacggggttcggaacccggtaaccgggtccctacggtaggaacgttaaccgtaggttttaactttttccgtaccgtttaccggttctactttcctaacgtttccggtaccttaaccgtacggttccgtaacggtaacccgggccgggtacgtacgtaaacgttccggtttaaccttccgtagtacccgtaacttaacgtcttaccgtccccttaccccgttaccccctaagttaccgtttcggtaacggacggtaccgtacgttacgaactcgtaactaacgccgtaagtcgtacgtctacgacgacctgtccgttac

SEQ ID NO: 273185 - DNA, 714 bp, Homo sapiens
  misc_feature: GYAE6OF01A0680.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtcgccagcctccctgtctgcaagtgtgggagacagacgtcctacccgtttttcggccgggcggtacggtccggccctaagttcggacgtacgtggtttcggccttggtactcggcgtgacgaccgacgggccaacctcctactaaccttctgtaacttactacccgttctacgtcgtcttgttacgcgtacggttccgggtccctaccgttcggtcgacggtcggactaacggtctcgtcgaagtactagtttactttttccgtcttcgttactacttcgtacgttcggttactacgtacgttacgtacggaaccggtaccggtcacgtaacgttcgttacctttctacgtacctaacctcttaacgtcccgtaaccccttccccgttaaccccccttaattaccggttttacccgggacggtaacccgggtaacctaaacggttaccgtaaacctacgttaaccgtaaacgtacccggttaaacgtcgggttaccgaccgttacgtacccttaaaccttgttcccgttcgttaccgtttaacccg

SEQ ID NO: 273186 - DNA, 722 bp, Homo sapiens
  misc_feature: GYAE6OF01B3X1E.43.33.C11.1.454.CMB.1.raw
  modified_base (147)..(147): a, c, t, g, unknown or other
  misc_feature (147)..(147): n is a, c, g, or t
  modified_base (697)..(697): a, c, t, g, unknown or other
  misc_feature (697)..(697): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccngtatgtgacatcagatcgacccagtccgccacgccctccctgtctgacgtaaggtggtacgggagacaggtacgttccttacccgtttttcggaccgggtcgtacggtccgcctagttacgaccgtacgttcggtttcggtcgtggtacgtcggtcggtaggtaaccggaccgaacgggtaccctacccgtcctaccgtaacttctagtaacttacttaccttcactcgtcgttgtcgacgttaccgggttcggtccctacgtcggttcgacggtcggacgaccggtcgtacgtagacgtaacgttacgtttacgttttctcttacgtcgtactacgtacgttcgtacttacgtacgtacgtacggaccggaccggactacgttacgttaccgtttacttacggttacctaacgtaacgttaaccttacgtcccgtccccctttaccccgttacccccttaaagtttaccgttaccggtacggtaaccgggttaaaccgtaaagttaacggaaactcggttaacaacggttcgaacggttcgtcgtaacnccgtaaccaccttggttccttaccg

SEQ ID NO: 273187 - DNA, 684 bp, Homo sapiens
  misc_feature: GYAE6OF01BXLHC.43.33.C11.1.454.CMB.1.raw
  modified_base (205)..(205): a, c, t, g, unknown or other
  misc_feature (205)..(205): n is a, c, g, or t
  modified_base (657)..(657): a, c, t, g, unknown or other
  misc_feature (657)..(657): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccacgccctccctgtctgacaagtgtaggganacagacgttccgtaccgtttttcggccgggtccgtacgtccgggccctagttacgaccgtacgttggtttcggtccgttggtacgtccggcggtcggtacggaccggacgggaccaacccgttaccctaccgtaaccttacgttacggtacttaacgttacccgttcgtaacttccgtaccgttggttccgccgttccgggttccgggtccccgtacgttccggtacgtacgggtcggtacgtaccggtcgtcgtagacggtaacgtgttacttttactcttcgtctatcctagtcgttcacgtacgtacggtcgaccgacggcgtactaacgtcgtacgtcttacacaactctactccgtacccctcccttaccccctttaactacgtttacccgggcgtaaacgggttaccgtattaaccgaacctagcctaagtacgtacgttacgggngtacctcgacaccgtattcggttaccg

SEQ ID NO: 273188 - DNA, 723 bp, Homo sapiens
  misc_feature: GYAE6OF01AQEG0.43.33.C11.1.454.CMB.1.raw
  modified_base (571)..(571): a, c, t, g, unknown or other
  misc_feature (571)..(571): n is a, c, g, or t
  modified_base (596)..(596): a, c, t, g, unknown or other
  misc_feature (596)..(596): n is a, c, g, or t
  modified_base (659)..(659): a, c, t, g, unknown or other
  misc_feature (659)..(659): n is a, c, g, or t
  modified_base (706)..(706): a, c, t, g, unknown or other
  misc_feature (706)..(706): n is a, c, g, or t
tcagtgtgagtagtcacgaccggtgctcgatttagagtgagctcgttggggtttgggggcagaagtctctctcagtcaggacacagcatggacatgagggtccctgctcagctccgtgggactcctgctgtctcgtcgggccttcccagtacttccgaagtagttgtacgaactactaccgaagtacgtcggaacccaggtccgaccacgtccctcccgtgtctcggactaaggtcggtagggaacgacgaacggtacgttcccgtttacccggtttttcgggcccgggtacggtaccggtccggtccgtagttacggaaccgttgttcggtttacggtccgttggtacgtcggcggtaggaacggtacccggacggaccctaaccgtcctacgtaaccttcgagtaccgttacttaccgttactcgtcggtacttcggtcgtccggttacgggttccgggtaccctacggttcggtacgtacggtcgacggtacgtcgtgtccggagtacgttacgttcttttcgcgttactcgtactcgtacgttaccgtctacggtagttaccggacncggacgactacgtacttcgtacttntaccgtaacacgttacgtcctcccttccctacccgtaccttaacggttacgccgggttaacgngggttaacctggtacctaacgtacctatacgtacgagttcgacgttnacctactctcgtactcg

SEQ ID NO: 273189 - DNA, 930 bp, Homo sapiens
  misc_feature: GYAE6OF01C4057.43.33.C11.1.454.CMB.1.raw
  modified_base (135)..(135): a, c, t, g, unknown or other
  misc_feature (135)..(135): n is a, c, g, or t
  modified_base (160)..(160): a, c, t, g, unknown or other
  misc_feature (160)..(160): n is a, c, g, or t
tcagtgtgagtagtcacgaccggtgctcgatttagagtgagctcggttgggtttgggggcagaagtctctctcagtcaggacacagcatggacatgagggtccctgctcagcctccgtggcctcctgctgctcgngcctccagtacttccagtagtgtanactactaccgagaacgtccggtacccacggttcccgccgaccgtccccttcccgttcgtaccgtcgtacggtaaggtcggtagggaacgtaccgtacgtaccgtttacccgttttacccggttttcgggcccgggtccggtaaccggtccggtacccgtagttaccgtaccggtacgtttcggtttccggacgttacggtcgtccggtacggtagaccgaccggtacggtaccctaacccgttccttaaccgtaacctttcgtacgttaccttaccgttaccgtacgtactacgttcgtggttccgaccggtttccggtcggtacccctcggtttacggtcgacggtcgaccgacgtcgtacgtagaccgttacgttacgtttacttttccgaccgtttacgtacttacgttaccgttacgttcgtaaccttacgttacggtacggtaccggtaccggtaccggtaccggttaaccgttaccgttacgttaaccgtttaccgttaccgttaaccgtaaccgtttaaccgttacccgttaccccgtttacccccgtttaaccccccgttaaccccgttaacccggtttaacccgggtttacccgttaaacccggggggggggttaaccgttaaacccgggttaacgttaaaccgtaaacccgttaaccgttaaacggttaaacccggttacccggttaaccggtttaccggttacccggttacccgtaacggttaccccgttaaccgtttcccggttccgttttaaccccg

SEQ ID NO: 273190 - DNA, 650 bp, Homo sapiens
  misc_feature: GYAE6OF01E2K2Q.43.33.C11.1.454.CMB.1.raw
  modified_base (402)..(402): a, c, t, g, unknown or other
  misc_feature (402)..(402): n is a, c, g, or t
  modified_base (453)..(453): a, c, t, g, unknown or other
  misc_feature (453)..(453): n is a, c, g, or t
tcagtgtgagtagtcacgaccggtgctcgatttagagtgagctcgttgggtttgggggcagaagtctctctcagtcaggacacagcatggacatggagggtccctgctcagctccgtgggactcctgctgctcgtggctcccagtacttccagatgtcgacactccagatcgaacccagtcgccacgtcccttcccgtcgtctcgacaaggtggtaggacgacagtacgttccttaccgttttcggccgggcgacggtccggtacctagttcgtacgtacttggttcggccgtggtactcgtcgtacgacgaccgacggacctaccctactactaacttctagaacttactacgttcatccgtcgttgtccgtcgtacgggtccggtcctacggttccgtanaggtcggccgtaacggtctctaggatactagtttctttcctctacgttacncttacgtacgttcgttactactacgttcgacggaccggtacgcgacttaagttacgttaccttctaccgtacaacgtactacgtccgtaccccttcccttacccctaagttacttccgggtacgaacgggtactaagtaccgtaactaacgttacaacgtccgtaagtcgtacgtctactactacttcgtgttaccg

SEQ ID NO: 273191 - DNA, 621 bp, Homo sapiens
  misc_feature: GYAE6OF01BCV55.43.33.C11.1.454.CMB.1.raw
  modified_base (389)..(389): a, c, t, g, unknown or other
  misc_feature (389)..(389): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcctaccgtttttcggccgggtccgtaggtccggcccagttcgacgtacgtgtttcggctggtatcgcgtgagaccagggccaaccgtcctcacttctagtattactaccgtttcacgttcgtctgtcgcgtacggttccggggtccctaccgtcggttcacggtcggacgacggctcgtanacgtactagtcttttctcttctctactctacgttcggtactacgtagtcgtcggacggaccggcgtactaagttcgttaccttgtaccgtacctaactacgtacgtcctcccgttccccttacccctacttaacggttccggtaccggtaacggggtaaccctagttaacgaacctacgttacaacgtcgtaaccgttgtacggtcgtacgtaccctacctcgttcgttccg

SEQ ID NO: 273192 - DNA, 721 bp, Homo sapiens
  misc_feature: GYAE6OF01C2MEN.43.33.C11.1.454.CMB.1.raw
  modified_base (189)..(189): a, c, t, g, unknown or other
  misc_feature (189)..(189): n is a, c, g, or t
  modified_base (571)..(571): a, c, t, g, unknown or other
  misc_feature (571)..(571): n is a, c, g, or t
  modified_base (712)..(712): a, c, t, g, unknown or other
  misc_feature (712)..(712): n is a, c, g, or t
tcagtgtgagtagtcacgaccggtgctcgatttagagtgagctcgttgggtttggggcagaagtctctctcagtcaggacacagcatggacatgaggtccctgctcagcctccgtggacctcctgctgctcgtcggcctcccagtacttccgagtagtgtcgactctccagactcgacccagtccgccncgccctcctgtctcgctaagtggtggaacgacacggtacgttccgtttacccgtttttcgggcccggtacggtacgtcccggacccgtaggttgaacccggttcgttcggttttccggaccgttcggttacgtccggtccggttagaaccgtaccggaacgggaccccttaacccgtttacctaccgtaaccgtttcgtacggtaacttaccgttaccgtttcacgttcggtccttcggttcgaccggttaccggttacccgggtccctaaccggtttccggttagacggttcggactaccggtctacgtacgagtaccttagtttccttttacgtccgtcgtctacgtcctagttcgtacctagtcgtcgtacgacgccgnacgtacttagtcttacgtacgacctaactcgtaccgtccgtcccttcccttacccttacttcgtttacccgacgtacggtaaccgagttaacgacgtacgtactaacgtaccgactggttccgacgtacccgatacccgtnttcgttccg

SEQ ID NO: 273193 - DNA, 726 bp, Homo sapiens
  misc_feature: GYAE6OF01DK4AB.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctgcctcccagattccagatgtagacataccagatcgacccagtccgcacgtccctccctgtctgacgtaagtggtagggagacgagtacgttccttacccgtttttcggccgggtacgaccggtaccggcctagttcgacgtacgttaggtttcggtaccgttggttacgtcggtacggtagaaccgaaccggacggacctaacccttcctaactaaccgttctagtaacttacgtaccgttctaacgtctacgttgtacgtacggtacggttccggtaccctaccgttcggttacgtacggtacggtaccgtaaacggtctacgttacgacgtactacgtttacttttcctcgttacgtactactaccgttaccgtcggttaacctacgtacgttacgtacggtaccggacggtacgtactaacgttcgttacctcgtacgtactaactacgttaccttaccgtaccccttacccctacccgttaacgttacgttaccgggtacgaaaccggggtacttaaacgggaactaactaacctacgtaacgtacgtaacgttgacggttccgtactaaccctacgtgtttcgttaacg

SEQ ID NO: 273194 - DNA, 908 bp, Homo sapiens
  misc_feature: GYAE6OF01B4F7W.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagtacttccagatgtagacatccagtatcgacccagtccgccacgtccctccctgtcctgacgaagtggtgggacacgaacgtacttacccgtttacccgtttttcggcccgggtacggaccggtccggccctagttcggaccgttacggttgtttcggcgttacggtcttcggcggtagacgaccgacggacctacccgtcctacctaacttctagtacttaccttacccgtcgtactccgtcgttacggttccgtaccgttacccgggttccgggttacccctacccgggtttccggttccggtaacgggttcccggtaccggtaacccgggttaccttaccggtaacggtaacgttaacccgttacggtttttaccttttttacccgttcggtttcccgttaaccttcgttaaacccggtttcggtttacccggttaacttaacccggttcgttaaccggtaccgggtaacccgggtaccgggtcccggtaacgtaaacccgttttcgtttaaccgtttccttaaccggtaaccccttaaacttaccgggttaccttaaccccccgtttcccccggttaacccccctttaaacccccccgttaacggttaacccgggttttccccggtaacccggggttaaacccgggttacccgttaaacgttaccgtaaaccgttacgtaacccgttaaaccgggtccgtttaaccgccggggtttaccgtaccggttacccgtaccctacccgtttagttcccgtttaacccg

SEQ ID NO: 273195 - DNA, 816 bp, Homo sapiens
  misc_feature: GYAE6OF01CJRBS.43.33.C11.1.454.CMB.1.raw
  modified_base (208)..(208): a, c, t, g, unknown or other
  misc_feature (208)..(208): n is a, c, g, or t
  modified_base (419)..(419): a, c, t, g, unknown or other
  misc_feature (419)..(419): n is a, c, g, or t
tcagtgtgagtagtcacgaccggtgctcgatttagagtgagctcggttgggttggggcagaagtctctctcagtcaggacacagcagtggacatggacgggtccctgctcagtcctccgtaggcctcctgctgctcgtcggcctacccgatacttccagtattggtcacactaccagctaccgaccgacgtccgccacgtcccttccnggttcacgtacgtaggtgggaggacgtacgagtacgttcccgtttaccggttttcgggccgggtacgtaccggtccggaccttaggtaacgtccggttacggttcggttcgggtccgttaggtacgtccggtacggtacggaaaccggccgggtaaccggtaccctaacccgttccttaacgtaccttcgtacgtaccttacgtacccttnacgttcgtcgttggtcgtaccggtccggtccgtcctacggttagcggtagaccggacgacgtccgtacgtaaggtacctacgtttactttaccgtttcacgggttacctacgtacgttacctcggtacgttaacctagttacggtacgtaccggtacgggtaccgacgttactaaccggtttcctaacgttcgtaacttaaacccgtacgttaaaccgtcccggtttacccctaacccccgtttacccctttaaaccccggttagggttttacccccgggtaacgggtacccggtaaaaccgggttaacttaacgtaaaccggtaactacggtaacccgtacgttaagacccgggtttgacccgtcgtacggaacctttctaacctttccggttacc

SEQ ID NO: 273196 - DNA, 793 bp, Homo sapiens
  misc_feature: GYAE6OF01CEOJC.43.33.C11.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
tcagtgtgagtagtcacgaccggtgctcgatttagagtgagctcggttgggtttgggggaagtctctctcagtcaggacacagcatggacatggacggtccctgctcagctccgtggctcctgctgctcgtcgcctacccagtacttaccgagtatggtacacactaccagacgtcgaccctgtccgccnctccctctcgtcngacgtaggtggacggagacgagtccgttcccgttaccgttttcggccgggtcgtacggtccgtaccgtaggtcgacgtccgttggtttaccggcgttggtacgtcggacggtacggaacgacccggaacggtacccctaaccgttccgaccctttagtttcgtagtaacttaccgttaccgttcaccgttcgtacttgtccgtacgttcgggttaccggtccctacggtccgtcggacggtccgtacgaccggtcgtacggtacgtacggttactttacgtttttcttcccgttacttccgtaacttcgtccgtacggttcgtaacgtcgtacgtacgtcggaaccgtcgaactccgttattacccgttacgtcgttaaccgtaacccattacccgtttactccccgttaccctttaacccccgtaacccgttttacgtaaaccgggttttcccgaaaccggggtacgttaaaaccccggtaagtttcccggtaaacgtaaacttacccggaagggttaccccgttaaagtcccgggttccggtaaacttaccgcccttagtagtttccccctttaggtccttaaccccg

SEQ ID NO: 273197 - DNA, 849 bp, Homo sapiens
  misc_feature: GYAE6OF01EUKAY.43.33.C11.1.454.CMB.1.raw
  modified_base (587)..(587): a, c, t, g, unknown or other
  misc_feature (587)..(587): n is a, c, g, or t
  modified_base (616)..(616): a, c, t, g, unknown or other
  misc_feature (616)..(616): n is a, c, g, or t
  modified_base (839)..(839): a, c, t, g, unknown or other
  misc_feature (839)..(839): n is a, c, g, or t
tcagtgtgagtagtcacgaccggtgctcgatttagagtgagctcgttggggttgggggcagaagtctctctcagtcaggacacagcagtggacatggacgggtccctgctacacgcctccgtggacctcctgctgtctcgtcggacctccgagtacttccagtattgtacgactacgtaccgagtacgtaccgaacccgtacgtccggacctccggtccccttcccgttgttccgtacggtacggtaaggttacgggtaacgggagtaaccgtaacggttccgtttaacccgtttcccggttttaccgggaccgggtaccggtaaccggtccggtaccttacgttaccggaacgtttcgttcgggttcggacccgttaggttacgtccgggtacggtaggtaaccggtaccggaacgggtccctaacccgtcgttacgttaaccgttcgtaaccgtaagtttaacccgttaccggttacgtaaccgttccgggttacttcggttacccgggttaccggtcccggggtttaccccggtccttaaccgggttcgtacggtacggtcggtacccgtacgttcgttaccgnggtaaacgtcgtttactttcgttttaccncgttacgtctacgtcttacgtacgttacgttacggtcgttacggacggtacggaccgtactctttaaccgcgtttacgtactacccgtaataacgtcttaacccgtcctaccccttacccgttaccgtaacgtcgttacccgggtaagaccggttaaacgtcgtaaataccgtaagtaccgtaggttccaacggttcgacgttaccgtacgtacgttaccgtntttcgtaccg

SEQ ID NO: 273198 - DNA, 681 bp, Homo sapiens
  misc_feature: GYAE6OF01EUFIN.43.33.C11.1.454.CMB.1.raw
  modified_base (372)..(372): a, c, t, g, unknown or other
  misc_feature (372)..(372): n is a, c, g, or t
tcagtgtgagtagtcacgaccggtgctcgatttagagtgagctcgttgggtttgggggaagtctctctcagtcaggacacagcatggacatgagggtccctgctcagctccgtgggactcctgctgctctggcctccagtattccagatgtgacactccagatcgaccacgtccgccacgtcctcctcgtctgacgaaggtggtagggacgaacagacgttacgttaccgtttttcggccgggtcgacggtccggtacctagttcgacgtacgttggtttacggtccgttaggtacgtcgtcggtacgacgaccggaacggacctaacctcctactaactacgtacgtaactaacgtaccgttacactcgtnttgtcgtactacgggttcgggtaccctaccgttcggtactagtcggaccgaacggtctacgtacggacgtacgtagtttacttttctcgtacgtactacttcgtacgttagtactacgtacgtacgtcggacgtacgtacgacgtaacgtcgtttactacgtacgtaacgtaacctagtactacctacccttaacccctacccgtaacgttacttacgggtaccgtaagggtaccttaaggtacaaaacgtactaacgtaaactacggtacttaggcggactcgtaaccactagttcgtatcgtaaccg

SEQ ID NO: 273199 - DNA, 844 bp, Homo sapiens
  misc_feature: GYAE6OF01ETTMR.43.33.C11.1.454.CMB.1.raw
tcagtgtgagtagtcacgaccggtgctcgatttagagtgagctcgttgggtttgggggcagaagtctctctcagtcaggacacagcatggacatgaggtccctgctcagctcctgggactcctgctgctctggcctcccagcagattccagatgtgacactccagatgacccagtcgcccacgtcctccctgtctgactaaggtggtgggagacacgtagttccttacccgtttttggcccgggcgtacggtccggccctagttcggacgtacgttggtttcggtacccgttggttacgtccggtacggttacgacggacccgaacggggtacctaacccttcccgtaccttaaaccgtttcctacgtaacttaccgtttaacccgttactacgttccggtacctttcggttacgtacccggttaccggggtttcccgggttaccccctaacccggtttccggggttacgtaacgggttccgggtaacccgtaaccgggtccgttaccggtacggtaacggaaccgtttacgtttactttttttaccgtacctttaccggttacctacgtttacccgttaccgggttacggtttaacccttacgtaacgggtttaccgttaccggtaaccgggtaaccggtcccgttaaaccggttaacgtttaccgtttaacctttcgtacggtttaaccaaaccgttacgttaccgttcccgttaccccgtttaccccttacccccttaacgttaccggtttaccgggtacgtaaaccggggtaaccttaacgggttaactaacgtacctacgtaacgtcgtaacgtacgtcggtacctcgaccctactacg

SEQ ID NO: 273200 - DNA, 750 bp, Homo sapiens
  misc_feature: GYAE6OF01BG6E4.43.33.C11.1.454.CMB.1.raw
  modified_base (176)..(176): a, c, t, g, unknown or other
  misc_feature (176)..(176): n is a, c, g, or t
tcagtgtgagtagtcacgaccggtgctcgatttagagtgagctcgttgggtttgggggaagtctctctcagtcaggacacagcatggacatgaggtccctgctcagctcctgggactcctgctgctctggcttccagattccagatgtgacatccagatcgaacccacgtccgccncgtccctccctcgtcgtgactaaggtgtagggacgacagtacgttccgttacccgtttttcggccgggtacgacggtccggcctattcgacgtacgttgttcggccttggtaactcgcgtagacgaccgacgggacctaaccgtcctactaactcgtagtatacgtaccgttcgacgtcgtactggttacgtccttaacgggttccgggtaccctaccggttacggttcgtacggttcggaccggtaaccggtctacggtagtacgtacttacgttacgttttctcgttacgtctatactacgtcggtctaacgtattaccgtagaaccgtcggactaacgttaacgttctttacgttacgtacgtaaacctaactacgttacgttcctaccccggttacccttacccccggttaactttaaccgggtttacggtaccgggtaaaccgggttaccctaaacggtttaacggaacccttaaggttaacccgttaaacgtaccgtaaaccggtttcggaccggttcctacgggtaccctaacggtacctttacggttcccgttaacccttttcccg

SEQ ID NO: 273201 - DNA, 827 bp, Homo sapiens
  misc_feature: GYAE6OF01CDWSG.43.33.C11.1.454.CMB.1.raw
tcagtgtgagtagtcacgaccggtgctcgatttagagtgagctcgttgggtttgggggcagaagtctctctcagtcaggacacagcatggacatggacgggtccctgctcagtcctccgtgggacctcctgctgcctctcgcctccagcagtacttcagtactgtagaactactaccagtactaccgacccgtacgtccgccacgtccctccgttcgtccgtgacgtaaggtcggtagggacgtacgacgtacgttcccgtttacccggttttccgggaccgggtccgggtaaccggttcccggtacccgttacggttaccggtaaccggttccggtttcggtttccggttaaccggttcggttaccgtccgggtaccggtacgggaacccggaacccgggtaccggtacccgtaaccccttacccgttaccgtaaaccgtttcgtaacgtaaccgtttacgttacccgttctacgttaccgttcgttcggtcgtaccggttaccgggttccgggttacccctcggtttccgttaccgtacggtcggtaaccgtacggtcgtacgtaacggacgttacgttactttccttttccgtaccgtccgttactaccttcgttacgttacgtcgtaacgttcgttacgcgggaacccggtacggtacaacgtttcgttccttaccgttacgtaccaacttaaaccgttcgtaccctcccgttaccccttaccccttaacccgttagtaccggtttaccggaccggtaaaccggtaccttaagtacgaacttacgccttaaacgtgaactcggtcgatcggtacctattccgg

SEQ ID NO: 273202 - DNA, 703 bp, Homo sapiens
  misc_feature: GYAE6OF02FUVEK.43.33.C11.1.454.CMB.1.raw
tcagtgtgagtagtcacgaccggtgctcgatttagagtgagctcgttggggtttgggggcagaaagtctcgtcttcagtcacggacactagctattggactatgagggtcccgtgcttcaggctcctggggactcctgctgctcctggctccccagcacgatttccagactgtggacatccgagactgacccaagtcgccaagcctcctgtctgctaagtgtgggagaccagaagtcaaccttttttgccggcgtagtccggccattgaaccgacgtgtttggccccttaggtactcgcgttgaggaccagggtcaacccgtcctccgtaaccttctacggaattactaaccggttcacttccggcgttcggtttggactacggttcggggttccccaccgttcggtttccaacggtgaccaacggccttcgtgacgacctagtaatttttctcgttcgtctattactacttcggtctacgtacgtctacgtacgtacggtccgtactaacttcgttacctttcgtacggttaccgaaaccgtaacgttagtacgtacccttaccctaaccccccttaaacttaacgttttaccgggtaccgtacggggtaaccctaacggtttacgaaccgttaacgttacctaaacgtttaccggtaaccgtttccggttacggtaccgttcggtacctaacccttaaccg

SEQ ID NO: 273203 - DNA, 506 bp, Homo sapiens
  misc_feature: GYAE6OF02F8EH8.43.33.C11.1.454.CMB.1.raw
  modified_base (375)..(375): a, c, t, g, unknown or other
  misc_feature (375)..(375): n is a, c, g, or t
  modified_base (446)..(446): a, c, t, g, unknown or other
  misc_feature (446)..(446): n is a, c, g, or t
tcagtgtgagtagtcacgaccggtgctcgatttagagtgagctcggttagggtttgggggaagtctcgtctccagtacaaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttaggcctggtatcgcgttgagacccagggcaaccctcctcaacttcctgactataccgttcatcgctgttgcacgttggggtcccacctcggttcagtggcacggctcgtgagacagattttcnctcgtcatcactggtctacgagtctgacgacggcgcaatgtacttctgtcacactatgcctctccccctanaactttcgtcacgggaccaagttgacatcaatcgaactgtggctgccaccatctgtcttc

SEQ ID NO: 273204 - DNA, 506 bp, Homo sapiens
  misc_feature: GYAE6OF02GFOBK.43.33.C11.1.454.CMB.1.raw
  modified_base (366)..(366): a, c, t, g, unknown or other
  misc_feature (366)..(366): n is a, c, g, or t
  modified_base (418)..(418): a, c, t, g, unknown or other
  misc_feature (418)..(418): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttgggtcccactcggttcagtggcaacggctcttagactagatttttcnctcgtcatcactggtctacagtctgacgacgcgcaatgtacttctgtcaacnctatcgccctccctaccctattacgttcgacggacgactagtacactactaacactacgaagttgtcgtctcaccacacttctgttcc

SEQ ID NO: 273205 - DNA, 494 bp, Homo sapiens
  misc_feature: GYAE6OF02HVJ81.43.33.C11.1.454.CMB.1.raw
  modified_base (290)..(290): a, c, t, g, unknown or other
  misc_feature (290)..(290): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (467)..(467): a, c, t, g, unknown or other
  misc_feature (467)..(467): n is a, c, g, or t
  modified_base (490)..(490): a, c, t, g, unknown or other
  misc_feature (490)..(490): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacctttttgccgggcgagtcggcccattgacgactgtttggcctggtatcgcgtgagaccagggcaacctcctcaacttcngatataccgttcatcgctgttgcacgttgggtcccactcggttcagtgcaacggctctgagacngtatttttcncttcgtcatctactggtctanagtctgacgacggcgacaattcgtaacttctgtcaacactatcgcctcctccccctatacttcgcagggaccagttcgaacntacaatcgaactgtcgctgcacntctc

SEQ ID NO: 273206 - DNA, 510 bp, Homo sapiens
  misc_feature: GYAE6OF02F7JYA.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgttggcctggtatcgcgtgagaccgagggccaacctcctcaacttctgatataccgttcatcgctgttgctacgttggggtcccaccgtcggtcagtgcaacggctctgagacagtattttctcttcgtcatcactggtctactagtctgacgacggcgcaattgtacttctgtacaacactatcgccttcctccccctatactttcgacgacgggacctaagttcgaactatacaactcgaactgtagctgccacatctgtcttac

SEQ ID NO: 273207 - DNA, 664 bp, Homo sapiens
  misc_feature: GYAE6OF02IULYK.43.33.C11.1.454.CMB.1.raw
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtggtgggagacagagtctacctttttggccgggcgtagtcggccattgacgacttgtttcggcctggtatcgngtgagaccgngggccaacctcctacaacttctgatactaccgtcatcgcttgtgctacggttcgggtccaccgttcggtcaggtcgacaacggtctcgtagagactagtactttttcgacttcgtactattcgtacgttcggtactacgtacgtcgtacgtaacggacggacgtacctaaagttcgtttacgtttacgttacgtacctaaactaacttacgtaccgtccccttacccgttaccccccttaaacgttaaccgttttccgggtaccgtaaacgggggtaaccctaaaggtttaccgaaacctacgttaaccgtaaacgttaaccgtaacgtacggttacggtcccgttaacggtaccctaaccgttaacttccgttacgtttccctttaaccg

SEQ ID NO: 273208 - DNA, 496 bp, Homo sapiens
  misc_feature: GYAE6OF02HG655.43.33.C11.1.454.CMB.1.raw
  modified_base (442)..(442): a, c, t, g, unknown or other
  misc_feature (442)..(442): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagtattttctctcgtcatcactggtctacagtctgacgacggcgcaatgtacttctgtcaacactatgccttcctccccctanaactttcgtcagggaccaaggttcgaacatcaatcgaactgtagctgcacctac

SEQ ID NO: 273209 - DNA, 606 bp, Homo sapiens
  misc_feature: GYAE6OF02JQ61D.43.33.C11.1.454.CMB.1.raw
  modified_base (419)..(419): a, c, t, g, unknown or other
  misc_feature (419)..(419): n is a, c, g, or t
tcagtgtgagtagtcacgaccggtgctcgatttagagtgagctcgttgggtttgggggtaaggtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccggcgagtcggcccatgacgactgttggcctggtatcgcgtgagaccgagggcaacctcctcaacttctgatactaccgttcatcgctgtgctacggttcgggtcccacctcggttcagtcggcaacggctcgtgagacgtagttacttttctacgttccgtctatcctacgttggtcctacaggttcctgacgacggcncgtaattcgttacttcgtgttaccaagtaccttagtcgcccctttacccctacccccttaacgtaacgtttttccgggaaccgtaacggggtaccctaaaggtttcgaaacttcttaccgaaagttaccgtaacgttcggacgggttacctcggtaccctaacctagttcccgtttgttacccttcg

SEQ ID NO: 273210 - DNA, 491 bp, Homo sapiens
  misc_feature: GYAE6OF02F25G6.43.33.C11.1.454.CMB.1.raw
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacctttttgccgggcgagtcggcccattgacgactgtttggcctggtatcgcgtgagaccagggcaacctcctcaacttctgatataccgttcatcgctgttgctacgttcgggtcccaccgtcggttcagtggcaacggctctgagacagtatttttcnctcgtcatcactggtctacagtctgacgacggcncatgtacttctgtcaactactatcgcctcctcccctatacttcgtcagggacctagttagactatcaatcgactgcgctgcacatctg

SEQ ID NO: 273211 - DNA, 535 bp, Homo sapiens
  misc_feature: GYAE6OF02HU3HR.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacctttttgccgggcgagtcggcccattgacgactgtttggcctggtatcgcgtgagaccagggcaacctcctcaacttctgatactaccgttcactcgctgttcgctacggttggggtcccaccgtcggttcagtcgcaacggctctgagacagtattttctctcgtcatcactcgtctacagtctgacgacggcgctaagtcgtacttctgtacaactactatcgacccttccgtccccctaactaactttccggtacgacgggaacctagttacgaactatacaataccgaatcgtacgcgtgtaccacctactctcgttcttacc

SEQ ID NO: 273212 - DNA, 546 bp, Homo sapiens
  misc_feature: GYAE6OF02IEEJT.43.33.C11.1.454.CMB.1.raw
  modified_base (364)..(364): a, c, t, g, unknown or other
  misc_feature (364)..(364): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagcagatttttcnctcgtcatcactggtctacagtctgacgcggcgcaattgtacttctgtacaactactagtcgccttcctcccccctataacttttccggtcaacggggtaccctaaaggtttcgaaacctattaccgaaattccgaaacgttggtacggcttacgcctacccactcttaggttcctttaccg

SEQ ID NO: 273213 - DNA, 714 bp, Homo sapiens
  misc_feature: GYAE6OF02JDKYH.43.33.C11.1.454.CMB.1.raw
tcagtgtgagtagtcacgaccggtgctcgatttagagtgagctcgttgggtttgggggcagaagtctctctcagtcaggacacagctatcggacatgagggtcccgtgctcacgctcctgggctcctcgctgctctggctccagagttcccagatgtgacatccgagactgacccagtcgcagcctcctgtctgcaagtcgtggagacagagtctaccgtttttggccggtcgacgtcggccattcgacggacgtgttggacctggtatcggacgttgacgtaccagggactaaccgtccgtacgtaacctttctacgtacttacgtaccgttctaacgtacgtcgttgttcgtaccgtaacggttcggggtccctaaccgttccggttcgtaacggttcggaccgtaaacggtccttcgtacggtaacgttacctaggttaacgtttttccgtacgttacggttacctaagttccgaaccgtttcgggtccttaacgtaacggttcgttacggttaaccgacggtcgactaaaggttcgttaaccgttcgttagtacctaaacgtcgttaacttcggtacccttccgttacccccttaagtaaaccgttttccggaaccgtacggggtacccacggtttacgaaccgtaaccgttacgaaccgtacgtaacgtcggtacggcctacgtaccgtaacccttgtacccttaccgg

SEQ ID NO: 273214 - DNA, 553 bp, Homo sapiens
  misc_feature: GYAE6OF02I2B76.43.33.C11.1.454.CMB.1.raw
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgctgttggcctggtatcgcgtgagtaccagggcaacctcctcaacttctgatactaccgttcatcgctgttgctacgttgggtcccacgtcggttcagtgcaacgctcgtgagacngtattttcnctcgtcatcactggtctacagtctgacgacggcncgaacttgtaacttctgtaccaactactagtcgtccctacctcccccttactaacgtttccggtacgacggggtaccctacgtacgtaaccaactacctaaatccggaaaccttggttacgggacttaccggacctaaccgtataccgtttcg

SEQ ID NO: 273215 - DNA, 525 bp, Homo sapiens
  misc_feature: GYAE6OF02JRADG.43.33.C11.1.454.CMB.1.raw
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
  modified_base (493)..(493): a, c, t, g, unknown or other
  misc_feature (493)..(493): n is a, c, g, or t
tcagtgtgagtagtcacgaccggtgctcgatttagagtgagctcgttgggtttgggggtaaggtcgtctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggcctggtatcgcgtgagaccagggcaacctcctcaacttctgatactaccgttcatccgcttgttgctacggtttcggggtccccacgtccggttcaggtcgggcaacggtcctcgtggagacgtagtacttttttcncttcgtctactcncttggtctactagtctgacgacggcnaattcgtacttctgtacacacttancgcctcctcccctatactttcgtcagggaccagttcactntacaatcgaatgtgctcgcactatctgtcttc

SEQ ID NO: 273216 - DNA, 498 bp, Homo sapiens
  misc_feature: GYAE6OF02ITBEG.43.33.C11.1.454.CMB.1.raw
  modified_base (405)..(405): a, c, t, g, unknown or other
  misc_feature (405)..(405): n is a, c, g, or t
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggccattgacgactgtttggcctggtatcgcgtgagaccagggcaacctcctcaacttctgatataccgttcatcgctgttgctacggttcggggtcccaccgtcggttcagtggcaacggtctacttagacagtattttctctcgtcatcactgtctacagtctgacgacggcnctaatgtacttctgtcaactactatcgcctcctcccctanactttcggcagggaccagttnaacatcatcgaactgtgctgccacntctntcc

SEQ ID NO: 273217 - DNA, 510 bp, Homo sapiens
  misc_feature: GYAE6OF02G4NSU.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccactcggttcagtgcaacggctctgagacagtattttctctcgtcatcactggtctacagtctgacgcggcgcaatgtacttctgtcaactctatcgcctcctccccctataacgtttccgtacgtacgggacctaaggttcgaactatacaagtccgaacttggtcgctgaccacctacg

SEQ ID NO: 273218 - DNA, 530 bp, Homo sapiens
  misc_feature: GYAE6OF02GPC00.43.33.C11.1.454.CMB.1.raw
  modified_base (364)..(364): a, c, t, g, unknown or other
  misc_feature (364)..(364): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgtacatccagatgacccagtcgccagcctccctgtctgcaagtgtgggagacagagtcaccctttttgccgggcgagtcggccattgacgactgtttggcctggtatcgcgtgagtaccagggcaacctccgtcaacttctgatataccgttcatcgctgttgctacgttgggtcccactcggttcagtgcaacggctctgagacagtattttcnctcgtcatcactggtctacagttctgacgacggcgcaattcgtacttctgtacaactactatcgacccttccgtaccccctataacgtttcggactagggaccctaagttcgaacacgtacaataccgtaactgtggtactggaccaccgtatcgttagtcttacc

SEQ ID NO: 273219 - DNA, 534 bp, Homo sapiens
  misc_feature: GYAE6OF02F6644.43.33.C11.1.454.CMB.1.raw
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaaccctttttgccgggcgagtcggccagttgacgacttgtttggccttggtaatcgcgtgagaccagggcaacctctcaacttctgatanaccgttcatcgcctgttgcacgttgggtccacctcgttcagtggcaacggctctgagacagtatttttcncttcgtcatcactggtctacngtctgacgacggcncaattntacttctntccaactactatgacccttctaccccctataacgtttccgtacgtacggggacctaggttagaacctagtaccaaagtccgaacgtgtcggacttacgcctaccctacgtcttacg

SEQ ID NO: 273220 - DNA, 699 bp, Homo sapiens
  misc_feature: GYAE6OF02GILT8.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctcgcgtccaccagtctacgagtagtgtacactactacgagtagtaccgaccgtacggtccacgccgtccccttccgttcgttcgtacgaacgtaggttgggagggaacgacgaggtacgttacccttttaccggtttcgggccgggtacgtacggtcccgactagttacggaccgttacgtttcgggttccggtcggttaggtacgtccggtacggtaggaccgaacggacggtaccctaacccttcctaaccgttacttcgtagtaacttaccgttaccttacacgtccgttcgtttggtcgtaccggttaccggggttcccggtacccctaccggtttcggtacgtacgggtcgaaccggtacgtctgaggaacgtacgttattttctttcctcgttctatactactcggttcgtactagtctcgacggaccgcggcaatgttacttctgactaacacttacgtcgtccctccctacccctaccttaaagtttccggtcgacgggaaccgtacttaggtaacacgtctaacgtactacgttagtggcgtcacgaccacttcgtgttcc

SEQ ID NO: 273221 - DNA, 496 bp, Homo sapiens
  misc_feature: GYAE6OF02G1Y29.43.33.C11.1.454.CMB.1.raw
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (438)..(438): a, c, t, g, unknown or other
  misc_feature (438)..(438): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagatttttcnctcgtcatcactggtctacngtctgacgacggcgcaatgtacttctgtcaacactatcgcctctccccctanaactttcggcaggggaccagttcgaacatcaatcgaactgtcggctgccaccatctcg

SEQ ID NO: 273222 - DNA, 492 bp, Homo sapiens
  misc_feature: GYAE6OF02GML3U.43.33.C11.1.454.CMB.1.raw
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (439)..(439): a, c, t, g, unknown or other
  misc_feature (439)..(439): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttgggtcccactcggttcagtggcaacggctctgagacagtatttttcnctcgtcatcactggtctacagtctgacgacggcncaatgtacttctgtcaacactatcgcctcctccccctanaactttcggcagggaccagttcgaacatcaatcgaactgtgctgcacatctcg

SEQ ID NO: 273223 - DNA, 500 bp, Homo sapiens
  misc_feature: GYAE6OF02GU2JQ.43.33.C11.1.454.CMB.1.raw
  modified_base (406)..(406): a, c, t, g, unknown or other
  misc_feature (406)..(406): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (492)..(492): a, c, t, g, unknown or other
  misc_feature (492)..(492): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgctacggttcggggtcccaccgttcggttcagtggcaacggctctgagacagtatttttctcttcgtctatcactggtctacagtctgacgacggcncaattgtacttctgtacaacactatcgcctcctccccctatactttcgcagggacctagtnacntacaatcgaactgcgctgcacntctgtctc

SEQ ID NO: 273224 - DNA, 491 bp, Homo sapiens
  misc_feature: GYAE6OF02G259T.43.33.C11.1.454.CMB.1.raw
  modified_base (366)..(366): a, c, t, g, unknown or other
  misc_feature (366)..(366): n is a, c, g, or t
  modified_base (420)..(420): a, c, t, g, unknown or other
  misc_feature (420)..(420): n is a, c, g, or t
  modified_base (487)..(487): a, c, t, g, unknown or other
  misc_feature (487)..(487): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagaccagtatttttcncttcgtcatcactgtctacagtctgacgacggcgcaattgtacttctgtcaacnctatcgccctctccccctatactttcgcaggaccagttcacatcaatcgactgtgctgcaccatctntctc

SEQ ID NO: 273225 - DNA, 518 bp, Homo sapiens
  misc_feature: GYAE6OF02I4LUV.43.33.C11.1.454.CMB.1.raw
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
  modified_base (482)..(482): a, c, t, g, unknown or other
  misc_feature (482)..(482): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgtctgttgctacgttggggtcccacgtcggttcagttggcaacgggctctgacgactagtatttttctctcgtcactcactggtctacngtctgacgacggcgctaatgtacttctntcaacactatgccctctccccctactaactttccggtcacggggtaccagttcgaactntactaataccgtactgtcggcttgaccacatctacg

SEQ ID NO: 273226 - DNA, 550 bp, Homo sapiens
  misc_feature: GYAE6OF02JE2OA.43.33.C11.1.454.CMB.1.raw
  modified_base (445)..(445): a, c, t, g, unknown or other
  misc_feature (445)..(445): n is a, c, g, or t
  modified_base (542)..(542): a, c, t, g, unknown or other
  misc_feature (542)..(542): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccggcgagtcggccattgacgactgtttgcctggtatcgcgtgagaccaggcaacctcctcaacttctgatactacgtcatcgctgttgctacgttcgggtcccaccgtcggttcacggtcggacgaacggtctcgtgaacgactagtactttttctcttcgtacattcacgttggtctacgtagtctgaccgacggcgactaatcgtacttctgtacaactactntcgccttccctacccccttaagtacttccggtacacggggtaccctagttagaaccagttaccaagttacgacgttgtacggtctacgcctaacgtnttcgtacg

SEQ ID NO: 273227 - DNA, 556 bp, Homo sapiens
  misc_feature: GYAE6OF02IBF0J.43.33.C11.1.454.CMB.1.raw
  modified_base (397)..(397): a, c, t, g, unknown or other
  misc_feature (397)..(397): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggcctggtatcgcgtgagaccagggcaacctcctcaacttctgatataccgttcatcgctgttgctacgttcggggtcccaccgttcggttcagtcggcaacggctctgagactagtatttttctctcgtctatcacttggtctacngtctgacgacggcgacaatgttacttctgtaccaacacttatcgcccttccctcccccctaactaaccgtttcggtacgacggggacctaagttagaactacgttactaaacgtaccgtaacttcggtcggtacctaggaccctaacctactccttacg

SEQ ID NO: 273228 - DNA, 549 bp, Homo sapiens
  misc_feature: GYAE6OF02JNC7M.43.33.C11.1.454.CMB.1.raw
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
tcagtgtgagtagtcacgaccggtgctcgatttagagtgagctcgttgggtttgggggtcgagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggccattgacgactgttggcctggtatcgngtgagaccagggcaacctcctcaacttctnatataccgttcatccgctgttcgctacggttcggggtccccacgttcggttcctaggtcggaccaacgggctcgtgagacagttatttttcncttcgtctatctacgttcggtctacncgttctcgacgacggctactaattcgtacttctagttcaactctatcgcccttccgtcccccttataactttccggacaggggtacctagttcgaactctacaataccgtaatggtacggctcgaccacctattctacg

SEQ ID NO: 273229 - DNA, 529 bp, Homo sapiens
  misc_feature: GYAE6OF02G8QZ2.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgatccagtcgccagcctccctgtctgcaagtgtgggagacagagtctaccctttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagactagtacttttctctcgtcatcacttgtctacagtctgacgacggcgcaatgtacttctgtacaactactatcgtcccttcctcccccctaactactttcggtacgacggggtacctaaggttacgaacctattaccaagtacgtaactgtacggctcgacctaacccg

SEQ ID NO: 273230 - DNA, 526 bp, Homo sapiens
  misc_feature: GYAE6OF02GVYDR.43.33.C11.1.454.CMB.1.raw
  modified_base (487)..(487): a, c, t, g, unknown or other
  misc_feature (487)..(487): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaaccgtcctcaacttctgatataccgttcatcgctgttgctacgttcggggtcccacctcggttcaggttcggcaacggctctagacgacagtactttttctcttcgtcatcactggtctacagtctgacgacggcgcaattgtacttctgtcaacactatcgcccttcctccccctataactttcgtacgacgggtacctagttcgaactntacaactaccgaacttgtcgtctcgaccacctatcttcg

SEQ ID NO: 273231 - DNA, 558 bp, Homo sapiens
  misc_feature: GYAE6OF02I9BY1.43.33.C11.1.454.CMB.1.raw
  modified_base (375)..(375): a, c, t, g, unknown or other
  misc_feature (375)..(375): n is a, c, g, or t
  modified_base (413)..(413): a, c, t, g, unknown or other
  misc_feature (413)..(413): n is a, c, g, or t
tcagtgtgagtagtcacgaccggtgctcgatttagagtgagctcgttggggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacctttttgccgggcgagtcggccatgacgactgtttggcctggtatcgcgtgagaccagggcaacctcctcctaacttctgatataccgttcatcgcttgttcgctacgttcggggtcccaccgttcggttcaggtggcaacggctctgagacagtatttttcnctcgtcatcacttggtctactagtctgtagtcgacggngactaagttcgttactttctgtacgaactacttactcgtacccttccctacccccttaataacgtttcggtacctaacggggtacctaaggttcgaaactactacgtaactcgtaacgtggtacggtcctagtccacctacgttc

SEQ ID NO: 273232 - DNA, 524 bp, Homo sapiens
  misc_feature: GYAE6OF02IGNXM.43.33.C11.1.454.CMB.1.raw
  modified_base (366)..(366): a, c, t, g, unknown or other
  misc_feature (366)..(366): n is a, c, g, or t
  modified_base (448)..(448): a, c, t, g, unknown or other
  misc_feature (448)..(448): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtcacctttttgccgggcgagtcggcccattgacgactgtttggcctggtatcgcgtgagaccagggcaacctcctcaacttctgatataccgttcatcgctgttgctacgttcggggtcccacctcggttcagtggcaacggctctgagactagtatttttcnctcgtcatcagtcggtctacgagtcgtgacggtacggcgcaattgtacttctgtcaacactactcgcctccctaccccctanacttttccgacgtacggacctaagttacgaactatacaactcgaactgtgactcgaccactctactcgtcttaccg

SEQ ID NO: 273233 - DNA, 511 bp, Homo sapiens
  misc_feature: GYAE6OF02FF18O.43.33.C11.1.454.CMB.1.raw
  modified_base (371)..(371): a, c, t, g, unknown or other
  misc_feature (371)..(371): n is a, c, g, or t
  modified_base (481)..(481): a, c, t, g, unknown or other
  misc_feature (481)..(481): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgcttgttgctacgttcggggtcccacttcggttcagtggcaacggctctgagacagtatttttcnctcgtctatcactggtctacagtctgacgacggcgcaattgtacttctgtcaactactatcgcccttcctccccctataactttcggtcgacgggacctagtacgaactntacaatcgactggtcgctgcacctatctcg

SEQ ID NO: 273234 - DNA, 497 bp, Homo sapiens
  misc_feature: GYAE6OF02FO85F.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccactcggttcagtggcaacggctctgagacagtatttttctctcgtcatcactggtctacagtctgacgacggcgcaatgtacttctgtcaacactatcgcctcctaccccctataactttcgacagggaccaagttgactatcaatcgaactgtagctgcacatctgtcttc

SEQ ID NO: 273235 - DNA, 492 bp, Homo sapiens
  misc_feature: GYAE6OF02ITQ2X.43.33.C11.1.454.CMB.1.raw
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtccactcggttcagtggcaacggctctgagacagtatttttctctcgtcatcactggtctacagtctgacgtacgcgcaattcgtacttctgtccaatactatcgcctcctccccctatactttcgcagggacctagtcgacatcaatcgaatgtagctgcacntntcg

SEQ ID NO: 273236 - DNA, 529 bp, Homo sapiens
  misc_feature: GYAE6OF02J0LJ6.43.33.C11.1.454.CMB.1.raw
  modified_base (284)..(284): a, c, t, g, unknown or other
  misc_feature (284)..(284): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
tcagtgtgagtagtcacgaccggtgctcgatttagagtgagctcgttgggtttgggggcgagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctccncaacttctgatataccgttcatcgctgttgcacgtttgggcccacgtcggttcagtggacaacggctctgagacagtatttttcncttcgtcatcactggtctcagtctgacgacggcncatgtacttcngtccacactattcgccttcctccccctataacgtttccggacacgggtacctagttcgaacctatcctaatccggtaaactcggttacgtctacggtaccacctactcgttaccg

SEQ ID NO: 273237 - DNA, 506 bp, Homo sapiens
  misc_feature: GYAE6OF02GBWKG.43.33.C11.1.454.CMB.1.raw
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgctacgttcggggtcccaccgtcggttcagtggcaacggctctgagacagtatttttctctcgtcatcactggtctangtctgacgacggcncaattgtacttctgtcaacactatcgccctcctccccctatacgtttcgcacgggacctagttgactatacaactcgaactgtcgctcgcaccatctcgtcttac

SEQ ID NO: 273238 - DNA, 737 bp, Homo sapiens
  misc_feature: GYAE6OF02HOYBF.43.33.C11.1.454.CMB.1.raw
  modified_base (729)..(729): a, c, t, g, unknown or other
  misc_feature (729)..(729): n is a, c, g, or t
tcagtgtgagtagtcacgaccggtgctcgatttagagtgagctcgttgggtttggggggcacgaagtctcttctcagtcaggacacagcgatggacatgagggtccctgctcagctcctgggactcctgctgtctctggctccctagattccagatgtgacatccagatgaccctaggtacgccagtcccgtcccgtcgtactgcaacgtggttgggacgacagacgtacctaaccccttttttcggccgggtacgacggtccggcccgtaagttgaccgacgttggtttcggccctggtactcgacggtagacgtaccgagggactaacccgtcctacgtaacctttcgtacgaacttacgttaaccggttacctacgttcgtacgttgtttcgtaccgtaaccgggtttcggggtccccgtaccgttccgggttacaggttccggtaccgtaaaccggtcttaccgtacggaacgaaccgtaacgttactttttaccgttacgttaaccggttcgtaactttacgtaaaccttggttaacctaacgtacgttccttaagggacccggtacgggaccgacgtaacgttcgttaccttactacgtacctaactacgttagtccgtacctttaccctacccccttaattaccgtttccggacgtacggggtactacgtttacggaacctaagtccaagttaccgaacgttgtcggactcgacctaccttntccgttcg

SEQ ID NO: 273239 - DNA, 836 bp, Homo sapiens
  misc_feature: GYAE6OF02IE1DA.43.33.C11.1.454.CMB.1.raw
tcagtgtgagtagtcacgaccggtgctcgatttagagtgagctcgttgggtttgggggaagtctcctctcagtcaggacacgagtcattgggacatgagggtccctgctcagctcctgggactcctgcgtgtcgtctggactcccgtagtattccagtattagtggactactccagatagacccagtacgccgagcctcccgtgggtcttgcaagtcgtgggagaccagagtcctacctttttgccgggtcgacgtcggccctagttgacgtacttcgtttcggccttaggtaactccggtcgtcgacggtaccgtacggggccaaaccgtccctcaaccgttcgtaggacttagtaccggtttcactcggcttaggtttcgctaacggtttcgggggtaccctacggttacggttcacggttggacctaacggcctacgttacgacgtaacgtagttaacgttttttcctaccgttaccgttactacttccaacgttacgggttacctaacgtaacggttacttaacggaaccgtaccgggtacgtaaccgtaaacgttcgtttaacctttacgttacggtaacccgtaaacctaaccgtttaaggttaccggttaccccgttaccccgttaaccccccccgtttaaaggttaacccgttttttacccggggttaaccgtaaaccggggggtaacccttaaaacggggtttacggtaaaccgtaacgtttaaccggtaaacgttacccgggtaaaccgttcgggttaccggttaaccgttaggtaaccccttaaccgttaacgtttaccgtttaccggttaccgtttaaccccgg

SEQ ID NO: 273240 - DNA, 518 bp, Homo sapiens
  misc_feature: GYAE6OF02GCS58.43.33.C11.1.454.CMB.1.raw
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtccggcccattgacgactgtttggcctggtatcgcgtgagaccagggccaacctcctcaacttctagatataccgttcatcgctgttgctacggttcggggtcccaccgttcggttcagtggacaacggctctgagacagtattttcnctcgtcatcactgtctacngtctgacgcggcacaattgtacttctgtacaactctatcgccctcctcccctatactttcggacgtacgggacctagttcaactataccaagtccgtaactgtcgtctgaccactatcttcg

SEQ ID NO: 273241 - DNA, 546 bp, Homo sapiens
  misc_feature: GYAE6OF02GXAR8.43.33.C11.1.454.CMB.1.raw
  modified_base (408)..(408): a, c, t, g, unknown or other
  misc_feature (408)..(408): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggaccattgacgactgtttggcctggtatcgcgtgagaccagggcaacctcctcaacttctgatataccgttcatcgctgttgctacggttcggggtcccaccgttcggttcagtggcaacggctctgagactagtattttctctcgtcatcactggtctacagtctgaccgacggcncaattgtacttctagtacaacactatcgtccctccttaccccctataacgtttccggacgtacggggtacctaggttacgaactactaccaactaccggtaacttcggttacggctcggaccaaccctatccgttacg

SEQ ID NO: 273242 - DNA, 534 bp, Homo sapiens
  misc_feature: GYAE6OF02G82PB.43.33.C11.1.454.CMB.1.raw
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggcccattgacgactgtttggcctggtatcgcgtgagacagggccaacctcctcaacttctgatactaccgttcatcgctgttgctacggttcggggtcccaccgttcggttcaggtcggcaacggctcngagacagttactttttcnctcgtcatcactgtctacagtctgacgcgcgcaatgtactctncaacnctanctccctccctacccctatacgtttccgacgacgggtacctaagtcgactatacaacgtaccgaacgtgtacggtcctacggacctacctattccttcgttccttacc

SEQ ID NO: 273243 - DNA, 489 bp, Homo sapiens
  misc_feature: GYAE6OF02GSEHA.43.33.C11.1.454.CMB.1.raw
  modified_base (369)..(369): a, c, t, g, unknown or other
  misc_feature (369)..(369): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagattttcnctcgtcatcactggtctacagtctgacgacggcgcaatgtacttctgtcaacactatgcctctccccctanaactttcgcagggacaggttnaactatcaatcgaactgtgctgcactac

SEQ ID NO: 273244 - DNA, 575 bp, Homo sapiens
  misc_feature: GYAE6OF02HZEQU.43.33.C11.1.454.CMB.1.raw
  modified_base (303)..(303): a, c, t, g, unknown or other
  misc_feature (303)..(303): n is a, c, g, or t
  modified_base (419)..(419): a, c, t, g, unknown or other
  misc_feature (419)..(419): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacctttttgccgggcgagtcgccattgacgactgttggcctggtatcgcgtgagacaggcaacctcctacaacttctgtatactaccgttnactcgcttgttcgctacggttcgggtcccctacgttcggttcaggtgcgaacggctcgtgacgactagtactttttctcttcgtcatctacgtgtactacagtctagacgaccggngacaattgtacttctcgtacaacactactcgtcccctccttccccctaactaacgttttccggaccgtacggggtaccctaaacgggttacgaaacctagtaccgtaaacgtaccgtaaccgttaggttcggtaccgtacgaccctaaccttaacg

SEQ ID NO: 273245 - DNA, 504 bp, Homo sapiens
  misc_feature: GYAE6OF02H6B01.43.33.C11.1.454.CMB.1.raw
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccttttttgccgggcgagtcgcccattgacgactgtttggcctggtatcgcgtgagaccagggcaacctcctcaacttctgatactacgttcatcgctgttgcacgttgggtcccaccgtcggttcagtggcaacggctcgtgagacagtattttctctcgtcatcactggtctacngtctgacgacggcncaatgtacttctgtcaacactatncctcctccccctataactttcggtcacgggaccagttcgaactataccaatcgtaactggtcgctcgctacactctacg

SEQ ID NO: 273246 - DNA, 570 bp, Homo sapiens
  misc_feature: GYAE6OF02F5AQW.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgttggcctggtatcgcgtgagaccagggcaacctcctcaacttctgatataccgttcatcgctgttgctacggttcgggtcccaccgtcggttcagtggacaacggctctgagacagttatttttctcttcgtcatcactcggtctactgtctgacgacggcgcaattcgtacttcgtgtacaactactactcgacccttccctaccccctactacgtttccggaccgtacggggtaacctaagttacgaactactaaccgtaacgttaaccgtaacgtaggtcggtacgtacgaccgtaaccctattaccgttcgttaccttaccg

SEQ ID NO: 273247 - DNA, 514 bp, Homo sapiens
  misc_feature: GYAE6OF02H5XW1.43.33.C11.1.454.CMB.1.raw
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
tcagtgtgagtagtcacgaccggtgctcgatttagagtgagctcgttgggtttggggaaggtctctctcagtcaggacacagcatggacatgagggtccctcgctcagctcctgggactcctgctgctctggctcccagattccagatgtgacatccagatgacccagtcgccagcctccctgtctgcaagtgtgggagacagagtcacctttttgccgggacgagtcggcccattgacgactgtttggcctggtatcgcgtgagaccagggcaactcctcaacttctgatataccgttcatcgctgttgcacgttcgggccgacctcggttcagtgcaacgcgtctgagacagtattttctctgtacatcnctaggcttacagtctgacgaacggngacatagtcttctgtcaacactatcgctccctcccctaccaaattcggttcaagggaccaaatttgaacctaatccaaatacgtaacctagtgcttcacgaccaacttntcgtnttc

SEQ ID NO: 273248 - DNA, 554 bp, Homo sapiens
  misc_feature: GYAE6OF02G520O.43.33.C11.1.454.CMB.1.raw
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgctacggttgggtcccaccgtcggttcagtggcaacggctctgagacagtatttttcnctcgtcatcacgtggtctacgngtctgaccgacggcgacaattcgtacttctgtaccaacactactcgtccctacccttccccctaactaacgtttccggacgacggggtaaccctaggttacaaccgtatacctaaagtccgaacgttggtaccggtacttacgccctaacctacttcttacg

SEQ ID NO: 273249 - DNA, 500 bp, Homo sapiens
  misc_feature: GYAE6OF02G4XGX.43.33.C11.1.454.CMB.1.raw
  modified_base (411)..(411): a, c, t, g, unknown or other
  misc_feature (411)..(411): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttggggtcccactcggttcagtggcaacggctctgagacagtatttttctctcgtcatcactggtctacagtctgacgacggcgcatgtacttntcgtcaacactatcgcctcctccccctataactttcgatcgagggtaccaagttacgaacatacaataccgaactgtggcctgcacatc

SEQ ID NO: 273250 - DNA, 582 bp, Homo sapiens
  misc_feature: GYAE6OF02HI1I7.43.33.C11.1.454.CMB.1.raw
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtctaccctttttgccgggcgagtcggcccattgacgactgttggcctggtactcgcgtgagaccgagggcaacctcctactaacttctgatactaccgttcactcgctgttgctacggttcgggtcccactcggtcaggtcggcaacggctctgagactagtacttttcnctcgtcatcactggtactacgagtcnggacgacggcganaacttgtactcgtgtaccaactactatccgtcccttacccgttaccccctaacttaacgtttccggtacgtaccggggtaaccctaacggtttacgaaacctacttaaccgaaacgttacccgaaacgttcggtacggtaccctacgaccctaacccttaacg

SEQ ID NO: 273251 - DNA, 541 bp, Homo sapiens
  misc_feature: GYAE6OF02HBL6V.43.33.C11.1.454.CMB.1.raw
  modified_base (290)..(290): a, c, t, g, unknown or other
  misc_feature (290)..(290): n is a, c, g, or t
  modified_base (494)..(494): a, c, t, g, unknown or other
  misc_feature (494)..(494): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggcctggtatcgcgtgagaccagggccaacctcctcaacttcngatataccgttcatcgctgttgctacgttcggggtccctaccgtcggttcaggtcggactaacggctctgagacagtactttttctcgttcgtctactctactggtctacgagttctgacgcggcgcaagttgtacttctgtcaactatactcgccctcctaccccctataacgtttcgtacgacgggacctaagttcgaactntacgtaactacgtaactgtcgactcgaccacctactcttgtcttacc

SEQ ID NO: 273252 - DNA, 677 bp, Homo sapiens
  misc_feature: GYAE6OF02H1GT4.43.33.C11.1.454.CMB.1.raw
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagtgtgagtagtcacgaccggtgctcgatttagagtgagctcgttgggtttgggggtcgaggaaggtctctctcagtcaggacacagcatggacatgagggtcccgtgctcagctcctgggactcctgctgctctggctcccagacttccagatgtgacatccagatcgaccagtcgccagccttctgtctcgcaagtgtggagacagagtctaccctttttgccggcgacgtcggcccagttcgacgacctggttggcctggtactcgcgtgagaccgagggcaacctccgtanaaccttttcngacttattaccgtacatcgacttgttcgctacggttcggggttcccaaccgttcggttaccaaggttggaccgaaacggtcttccgttagaacgtacgacgtttaacgttttttccgtccgttcggttacacgttaccctaacgttacggttacctacccgtaaagttccgttacggacggacggaccgtaacgtaaacgttcgtttaaccgtttactcggttaacctaaacctaacttaaacgttcctaacccgttccccttaccccccgttaacttaaaccgtttcgttaacgacgggtaccaacgtttacgaacaacttacctaatccgaaacttgttacggacaggtaccctacagttcttaaccg

SEQ ID NO: 273253 - DNA, 553 bp, Homo sapiens
  misc_feature: GYAE6OF02FTU36.43.33.C11.1.454.CMB.1.raw
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagccctccctgtctgcaagtgtgggagacagagtcctaccctttttggccgggcgagtccggcccattgacgactgtttggcctggtatcgcgtgagaccagggcaacctcctcaacttctgattataccgttcacttcgcttgttgctacggttcgggtcccaccgttcggttcagtcggacaacggtctctgagtacagttattttctctcgtcatcactggtctacagtctgacgacggcncaattgtacttctntacaactactactcgtcccttcctacccccttaactaacgtttccggacgtacggggtaccctaggtcgaactataccaagtaccgtaacttggtacgtactcgaccacctagtcttacg

SEQ ID NO: 273254 - DNA, 559 bp, Homo sapiens
  misc_feature: GYAE6OF02I4E9B.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtctaccctttttgccgggcgagtcggcccattgacgtactgtttggccttggtatcgcgtgagaccagggaccaacctcctacaacttctgactactaccgtcatcgctgttgcgtacgttcgggtcccaccgttcggttcagtcggacaacggctactgagatagtttactttctctcgtcactctacgtgtactacgtactcgtacgacggtcgacgactagtcgttactcgtacgactactactctacgccctcccttaccctacgttacgttaccgacggtacggactaacggtactaactacaacgtaacgtacgtaacgttcggtacgctacgaccacgtacg

SEQ ID NO: 273255 - DNA, 577 bp, Homo sapiens
  misc_feature: GYAE6OF02JFXBN.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggccattgacgactgtttggcctggtactcgcgtgagaccagggcaacctcctcaacttctgatactaccgttcatcgctgttgcgtacggttcgggtcccaccgttcggtcagtcggacaacggctcgtgacgacagtacttttctcttcgtcatctacgtggtactacagtctcgacgtacggcgacaattcgtaacttctgtaccaactactactcgtcccttcccgtacccccttaagtaacgtttccggtacgtacggggtaacctaacggttacgaaccttactaacctaacgtaccgtaacgttcggtacggtactcgacctacctacgttccttaccg

SEQ ID NO: 273256 - DNA, 630 bp, Homo sapiens
  misc_feature: GYAE6OF02GIUCZ.43.33.C11.1.454.CMB.1.raw
  modified_base (295)..(295): a, c, t, g, unknown or other
  misc_feature (295)..(295): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttggccgggcgagtcggcccattgacgactgtttggcctggtatcgcgtgagaccgagggccaacctcctcaacttcngatactaccgttcatcgctgttgctacggttcgggtccccaccgtcggttcaggtcggccgaacggctgtgagactagtactttttctcttcgtctatcctacgtggtactacgtacgttctaggaccggtaccgggccgtactaacgttcggttacctttcgacgttacctaacctaacttacgttccgtccccttcccttacccccttaacgttaaccgttacggtttaccggtacggtaaccggggtacctaacggttacggaaacttaccgttaacaacgttaccggtacttcgggttacggtacgtccggtaccctaccgtacgttaccg

SEQ ID NO: 273257 - DNA, 676 bp, Homo sapiens
  misc_feature: GYAE6OF02JRGPB.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacccgtttttgccgggcgagtcggccattgacgactgttggcctggtatcgcgtgagaccgagggccaacctccgtacaacttctgatactaccgttcactcgcttgttcgcgtacggttcggggtcccacgttcggtcaggtcggcgtaacggctcgtagacgtacgagttactttttaccgtcttccgtctaacttccgtaacgttcggttacttacgtacgttcgtacggacgtaccgggcgtactaagttacgtttaccttacgttacgttaccaaaccgtacttaacgtccgtacccctttacccctaccccccttaacgttaacccgtttttccgggtaaccggtaacgggggttaacccctaaggttttaccgaacttaccgttaaccgtaacttaaccgtacgttacggtccggtacttaccgaccctaacccgtacgtttccgttacgttaccgtttacc

SEQ ID NO: 273258 - DNA, 669 bp, Homo sapiens
  misc_feature: GYAE6OF02ITJFU.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggcctggtatcgcgtgagaccgagggccaacctcctcaacttctagatactaccgttcatcgcttgttcgctacggtttcggggtcccctaccgttcggttcaggttcggaccaacggtctcgtgaagacgtagttatttttcctcgttcgtacctacttacctaacgttggttaccttacgtacgttctacggaacccgggtaccggacgtactaaagttcgttaacctttccgttacgtacctaaactacttaacgttccgtacccctttccctttaccccccttaagttaaccgttttccggtaaccggtaaccgggggtaacccttaaggtttaccgaaaccgtacttaaccgtaaacgttacccgtaaacgttggtacggtccttacggaccctaaccgtacgttccttaccgg

SEQ ID NO: 273259 - DNA, 665 bp, Homo sapiens
  misc_feature: GYAE6OF02H5EEX.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacccttttttggccgggtcgacggtccggcccagttcgacgtacttgtttggcctggtatcgcgtgagaccgagggctaacctcctcaacttctagatactaccgttcatcgtctgttcgtcgtacggttcgggtccctaccgttccggttcgagtcggactaacggtctacgtagacgactagttactttttccgtcttcgtctacttccgtacgttggtacctaacgtacgttacctcggaacccgtacggtccgtacgtaaacgttcggttacctttcgttacgtacctaaactaccgtttaacgtacgtccccttaccccgttaccccccttaacgttaaccgtttccggtaaccgtaacggggtaacctaacggttacgaacgtaacgtacctaaacgtaccgtaaccgttcggtacggtacctacgaccctaaccgtacgttcttaccg

SEQ ID NO: 273260 - DNA, 658 bp, Homo sapiens
  misc_feature: GYAE6OF02HYJW6.43.33.C11.1.454.CMB.1.raw
  modified_base (331)..(331): a, c, t, g, unknown or other
  misc_feature (331)..(331): n is a, c, g, or t
tcagtgtgagtagtcacgaccggtgctcgatttagagtgagctcgttgggtttgggggcagaaggtctctctcgagtcaggacacagcatggacatgacgggtccctgctcagctcctgggactcctgctgcctctggctccagtattccagatgtgtacatccagattgacccagtcgccagcctccgtgtctgcgtaagtggtggaggacgagtagtcctaacccgtttttggccgggtcgacggtccggaccctagttcgacgtacgttggtttcggccttggtactcgtcgtagacgaccgagggacaaccgtcctacgaactttcngactacgtaccgttcagtcgtcgttgtgcgtacggttacgggtccctacgtcggttcgtaggtcggacgaacggtctacgtgacgtactaggttacttttcgtcgttacgtcgacttctacgtacgtacgtatacgtacgtaggaccggaacggacgtaacgaacgttagtttaccttcgtacgtaacctaacgtaactagttaccgcccttaccctccccgttaacttaaccgttccggtacgtacgggtaacctaagttacgtaacgtacttaaccgtaacgtaccgtaacgtcggtacgacgtaccgactacctgtccgttacg

SEQ ID NO: 273261 - DNA, 634 bp, Homo sapiens
  misc_feature: GYAE6OF02HGVQI.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggcccattcgacgactgtttggccttggtatcgcgtgagaccagggcaacctcctcaacttctgatcgtaccttcatcgcttgttgctacggttcgggtccccaccgttcggttcacggtgacgaacggctcgtagacgactaagttactttttctcgttcgtctacttcctagttcggtacttacgtacgttcgtaggaccggacggaccgactaagttcgttacctttctcgtaccaacgtacttacgtcgtcccttcccttacccccttaacgttaaccgtttccggtaaccgtaacggggttaacctaacggtttacgaaaccgtaacttaccgtaaacgttaaccgtaacgttcgttacgggtacctacgtaccctaacccttagttaccgtttacccg

SEQ ID NO: 273262 - DNA, 565 bp, Homo sapiens
  misc_feature: GYAE6OF02F8032.43.33.C11.1.454.CMB.1.raw
tcagtgtgagtagtcacgaccggtgctcgatttagagtgagctcgttggggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttggccgggcgagtcggcccattgacgactgttggcctggtatcgcgtgagaccgagggcaacctcctcaacttctgatactaccgttcactcgcttgttcgcgtacggttcggggtcccaccgttcggttcagtcggcaaccggctcgtgagactagtacttttctctcgtcactctacttggtctacgtagttctagaccgcggcgtactaagttcgtacttctacgtaccaactacttatcgacccttccctaccccctaatacgtttccggacacgggtacctaaggttcaacatacgtaataccgtaactggtcggactcgacctacctatcgttcgtccttacc

SEQ ID NO: 273263 - DNA, 658 bp, Homo sapiens
  misc_feature: GYAE6OF02GL29Q.43.33.C11.1.454.CMB.1.raw
tcagtgtgagtagtcacgaccggtgctcgatttagagtgagctcgttggggtttgggggcagaagtctcgtctcagtcaggacacagcatggacatgagggtccctgctcagctcctgggactcctgctgctctggctcccaggattccagatgtgacatccagatgacccagtcgccagcctccctgtctgcaagtgtgggagacagagtctaccctttttgccgggcgagtccggcccattgacgactgtttggcctggtatcgcgtgagaccgagggcaaccgtcctcgaacttctagtactactaccgttcactcgcttgttgcgtacggttcggggtccctaccgtcggttctaggtcggacaacgggtctcgtacgacgtactacggttactttttcctacttcgtactactccaacgttcggtacttaccgtagttcctaggaccgaccggcgtactaaagttcggttaccttcgtcgtacgaaacctacgttactccgtcccttcccgtaccccccttaacgttaaaccgttttccgggacgtaacgggggtaaccctaacggtttacgaaaccgtaacttaccgtaaacgttaccgtaaccgttgggtacggtaccgttacgaacccgtacccgtacgttacgttaccg

SEQ ID NO: 273264 - DNA, 563 bp, Homo sapiens
  misc_feature: GYAE6OF02IGIMO.43.33.C11.1.454.CMB.1.raw
  modified_base (379)..(379): a, c, t, g, unknown or other
  misc_feature (379)..(379): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacccttttttgccgggcgagtcggcccattgacgactgtttggcctggtatcgcgtgagaccagggcaacctcctacaacttctgatactaccgttcatcgcttgttcgctacggttcggggtccccaccgtcggttcagtcggccaacggctctgagactagtatttttcncttcgtctatctactcggtctaacagttctacggacgcggcgactaaagttcgttacttctgtaccaactactatcgcccttcccgtccccctataacgttttccgacgacgggacctaagttcaaactctacaattcgaacttggacgtccgtcgacctaaccgtattccttcgttaccttac

SEQ ID NO: 273265 - DNA, 531 bp, Homo sapiens
  misc_feature: GYAE6OF02HK9WZ.43.33.C11.1.454.CMB.1.raw
  modified_base (379)..(379): a, c, t, g, unknown or other
  misc_feature (379)..(379): n is a, c, g, or t
tcagtgtgagtagtcacgaccggtgctcgatttagagtgagctcgttgggtttgggggcgagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcaccctttttgccgggcgagtcggcccattgacgactgtttggcctggtatcgcgtgagaccagggccaacctcctcaacttcgtagatataccgttcatcgcttgttgctacgttcgggtcccaccttcgttcagtggctaacggctctgagacagtactttttcncttcgtcatcactggtactacagtctgacgacggcactaatcgtacttctgtaccaactctatcgcctccctacccctataacgtttcgcgtagggtaccaaggttcgaactacgtacaactaccgtacttgtacggtctacgccacctacg

SEQ ID NO: 273266 - DNA, 549 bp, Homo sapiens
  misc_feature: GYAE6OF02GH1VJ.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacggttggggtcccacgtcggttcagtgcacggctctgagacagtatttttctctcgtcatcacgtggtctacagtctgacgacggcgacaattgtacttctgtacaactactatcgccctccctcccccttaataacgtttccggtactacggggtaacctaagttacgaactactacctaaagtaccgaacttcggtcggtctacgacctaacctattccgttcgtacctttaccg

SEQ ID NO: 273267 - DNA, 680 bp, Homo sapiens
  misc_feature: GYAE6OF02JQSZV.43.33.C11.1.454.CMB.1.raw
  modified_base (338)..(338): a, c, t, g, unknown or other
  misc_feature (338)..(338): n is a, c, g, or t
tcagtgtgagtagtcacgaccggtgctcgatttagagtgagctcgttgggtttggggggtcgagaagtctctctcagtcaggacacagcatggacatgagggtccctgctcagctcctgggactcctgctgctctggcctcccacgacttccacgatgtcgacatccagatgacccagtcgccagccctccctgtctgcacgtgtgggagacagacgtctaccttttggccgggcgacggtcggcctagttcgacgtacttgttcggccgtcggttactcggcgtgacggaccgagggccacctcctcacttctgatactaccgtcatcgtcttcgtnccgtacggttcgggtcccaccgttcggttctagggtcggtaccgtaaccggtctctacgggacacgtaagttcttttccgttctccgttcacttacctcgttcgtctacgtatcgtacggtacgcggtcactaagttcgttactcgtagacctaactacttactcccgtcccttaccccgttacccccttaacgttacggtttacccgggacgtacccggggggttaacccttaaccgggtttacaacccgtttaaacgtacctaaaaccgggtccgttaaccggttaggggttacccgtacggttaccgaacccggtaacccttacgttacccgtttacgg

SEQ ID NO: 273268 - DNA, 589 bp, Homo sapiens
  misc_feature: GYAE6OF02GFSFY.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacgagagtctaccctttttgccgggtcgacgtcggcctattgacgactgttcggcctggtatcgcgtgagacgaggcaacctcctacaacttctgatactaccgttcactcgtctgttgcgtacggttcggggtcccaccgttcggtcgtagtcggaccaacggtctcgtaggacgacgtagttactttttcctcgttccgttacacttcgtaaccgttggttactaacgtgttctggaaccggacgtcgactaagttcgtaccttcgtacgtcaaactactatcgtaccctccctaccccttatacgttcgtacgacgggtaacctagttacgactactactaactacgtaacgttggtcgactcgactacctattcttcgttacttccg

SEQ ID NO: 273269 - DNA, 609 bp, Homo sapiens
  misc_feature: GYAE6OF02HJ61F.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgacgtcggcccattgacgactgttggcctggtatcgcgtgagaccgaggccaacctcctcaacttctgatataccgttcatcgcttgttcgctacggttcggggtccctaccgttcggttcaggtcggaccgtaacggtcttcgtagaacgtactagttacttttttcctcgttcgtacattctacgtggttctacgtgttcgtaggaaccggtacggccgactaattcggttaaccttcgtacgtaccaaacgtacttactcgtcccctttccctaccccccttaataaccgtttccggacgtaaccggggacctacggttacggaacctaactactaactaccgtaacgttgtacggcgtacgaccgtactactcgtttacg

SEQ ID NO: 273270 - DNA, 524 bp, Homo sapiens
  misc_feature: GYAE6OF02F1M61.43.33.C11.1.454.CMB.1.raw
  modified_base (201)..(201): a, c, t, g, unknown or other
  misc_feature (201)..(201): n is a, c, g, or t
  modified_base (367)..(367): a, c, t, g, unknown or other
  misc_feature (367)..(367): n is a, c, g, or t
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtggganacagagtcaccctttttgccgggcgagtcggcccattgacgactgtttggcctggtatcgcgtgagaccagggcaacctcctcaacttctgatataccgttcatcgctgttgcacgttggggtcccactcggttcagtggcaacggctctgagacagtatttttcnctcgtcatcactggtctacagtctgacgacggcgcaatgtacttctgtcaacnctaatcgccctcctccccctaacaatttccggtnacggggacctaagttcgaaactactactaactaccgaacttaggtcggcttaggccaacctatccttacg

SEQ ID NO: 273271 - DNA, 609 bp, Homo sapiens
  misc_feature: GYAE6OF02HFNON.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatcgacccagtcgccagcctcctgtctgcaagtgtgggagacagacgtctaccctttttggccgggtcgagtccggccattgacgtacgttgttggcctggtactcgcgtgacgaccgagggctaacctcctctaacttctagatactaccgttcatcgcttgtgcgtacggttcgggtccctaccgttcggttcaggtcggacgaacggtctcgtagacgactagttacttttctcttcgtctactctacgttcggtactacgtagttcgtacgacggacggcgtacgtaaacgttcgttacttctacgtacctaactacttactaccgtcccttacccttaccccttaacttaacgtttccggtacgtaacgggtaacctagttacgaacgtactaacgtaagtaccgtacgtggtacggtactacgtacctactacttcttaccg

SEQ ID NO: 273272 - DNA, 813 bp, Homo sapiens
  misc_feature: GYAE6OF02H5TAE.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctcctgtctgcaagtgtgggagacagacgtcctacccgtttttggccgggtcgacgtcggcccagttcgacgtacgtgtttggcctggtactcgtcgtgagaccgagggcctaaccgtcctactaacttctagtatacgttaccgttctaacgtccgtacgttcgttacggaccgttacgggtttccggggtaccccctaccggtttccgggttaccgtagggttaccggggtaccgtaaaaccgggtccgtttacgtacggtaacggtaaccgtaacggttttactttttttcccgtaccgtttacccgttacgttacttacccgtaccggtttacgggtttacccttaacggttaccggttaccgttaacgggtaacccgggtaccgggtaccgtaacgtaacgtttaaccggtttaaccttccggtttacgtaacccttaaacgtacccgtttaacgtcccggtttaccccttacccccgtttacccccctaaagttttaaaccccggtttcgggtaaccgtaaccgggggttaaccctaaagggtttaaccgaaaccgttacgtaaccgttaaaccgtacggttaaccgttcgggtaaccggtccgttacgtaccctaccttaaccgg

SEQ ID NO: 273273 - DNA, 516 bp, Homo sapiens
  misc_feature: GYAE6OF02FGH5E.43.33.C11.1.454.CMB.1.raw
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacctttttgccgggcgagtcggcccattgacgactgtttggcctggtatcgcgtgagaccagggcaacctcctcaacttctgatataccgttcatcgctgttgctacgttcgggtcccaccgtcggttcagtggacaacggtctctgagacagtatttttcnctcgtctatcactggtcctacagtctgacgacggcgacaatcgtacttntcgtacaacnctatcgtccctcctcccctatactttcggacgacgggacctagtacgacaatcaatcgacgtgtacggcttcgctacacttgttcg

SEQ ID NO: 273274 - DNA, 617 bp, Homo sapiens
  misc_feature: GYAE6OF02GVPOI.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagccctccctgtctgcaagtgtgggagacagagtctaccctttttgccgggcgagtcggccattgacgactgttggcctggtactcgcgtgacgacgagggccaacctcctacaacttcgtgatactaccgttcatcgctgttgcgtacggttcgggtccctacgtcggttcaggtcggcaacggctcgtgagactagttacttttctcttcgtctactcacgttcggtctacgcgttctagaccggacggcgtacaagttcgtacttcgtcgtactaactacttcttccgtacccttcccttacccccttacgttaacgtttccggtaccgtaacggggtacccttaagggttaccgtaaacgtacgttaaccgtaaacgttaccggtaacgtttccgggtacgtccgttacggaccctaaccggttacttccgtttaccg

SEQ ID NO: 273275 - DNA, 727 bp, Homo sapiens
  misc_feature: GYAE6OF02IHSVJ.43.33.C11.1.454.CMB.1.raw
  modified_base (174)..(174): a, c, t, g, unknown or other
  misc_feature (174)..(174): n is a, c, g, or t
  modified_base (321)..(321): a, c, t, g, unknown or other
  misc_feature (321)..(321): n is a, c, g, or t
  modified_base (712)..(712): a, c, t, g, unknown or other
  misc_feature (712)..(712): n is a, c, g, or t
tcagtgtgagtagtcacgaccggtgctcgatttagagtgagctcgttgggtttggggtcgagaagtctctctcagtcaggacacagcatgacatgaggtccgtgctcagctcctggacgtcctgctgctctggctccacgattccagatgtgacatccagatcgaccagtcgcngcctcctgtctgcaagtgtgggagactagagtctaaccgtttttgccggtcgtacgtcggtcccgtattgacgtacgttgttggtcctggtacgtcgcgttgcgacgaggcaccgtcctactaacttctacgactactacccgttanacgtcgtactgttcgcgtaccggtcgggtcccaccgttcggttccacggtcggtacgtaaaccggcgttacgtacggtaacgtaaccgttaagggttacctttttaccgggtcccttacgggtttactacgtttacccgacgtttaaccggttaccgttaccgaacggtttcccgtaacgggttaccgtaacccggggtctaccgttaaaccgttcgttaaacccgtttcgtaccgtaccgttaaaccacccgttttacgacccggaccctttaccccttacccccgtaacgtttaacccgttccggtaaccggtaaccgggttacccgtagttaaccgtacctaaagtaccctaacgtaccgtaacgttcgtaccgtctccggttaaccncctagtcccttacgg

SEQ ID NO: 273276 - DNA, 613 bp, Homo sapiens
  misc_feature: GYAE6OF02INOHT.43.33.C11.1.454.CMB.1.raw
  modified_base (371)..(371): a, c, t, g, unknown or other
  misc_feature (371)..(371): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtggagacagagtcaccctttttgccgggcgagtcggcccattgacgactgttggcctggtatcgcgtgagacgagggcaacctcctcaacttctgatactaccgttcatcgctgttagctacgttggggtcccaccgtcggtcagtgcaacggtctcgtgacgactagtactttttccncttcgtcattcacttggtactacgtagtctcgacgtacggcgactaagtcgttaacttcgtacgtccaaactaccttatcgtacccttcccgtacccccctaataacgttttccgggaccgtaacggggtaaccctaaggtttaccgaaccgtaattaccgaaaacgttacccggtaaacttcgggttacggtaccttacggtacccaaccgttacgtttccgttacggttcctttaacccg

SEQ ID NO: 273277 - DNA, 609 bp, Homo sapiens
  misc_feature: GYAE6OF02HIZJU.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcagtgtgggagacagagtctaccctttttgccgggtcgagtcggcccattgacgtactgtttcggcctggtatcgcgtgagaccgaggcaacctcctctaacttctgatactaccgttcattcgcttgttcgcgtacggttcgggtccctaccgttcggttcgaggtcggacaacggtctacgtgaacgtacgtagttactttttctcttcgtactacttccgtacgttcggtacctacgtacgtcgtacggaaccggtaccggcgtactaaagttcgttaccttcgtacgtacctaacgacttactccgtcccttacccttaccccctaagttaccgtttccggacgtaccgggtaacctagttacgaacctgtactaacgtccgtaacgtgtcggctcgacctaccgtattccttacg

SEQ ID NO: 273278 - DNA, 609 bp, Homo sapiens
  misc_feature: GYAE6OF02GRO2P.43.33.C11.1.454.CMB.1.raw
  modified_base (384)..(384): a, c, t, g, unknown or other
  misc_feature (384)..(384): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggcctggtatcgcgtgagaccagggcaacctcctcaacttctgatataccgttcatcgctgttcgcgtacgttcggggtccctacgttcggttcaggtcggacgaacggtctcgtgagtacgtagttacttttttcncttccgtcatctactggttcctaacgtcgtctggaccggtaccgggcgactaattcgttactttcgtcgtaccaactacttacgtcgtaccccttccctacccccctacttaacgttttccggtaaccgtacggggtaaccctaaggttcgaaacctagtaccgtaaacgtaccgtaacgttggttcggactacgacctaacctacttcgttcgttaccttaccg

SEQ ID NO: 273279 - DNA, 655 bp, Homo sapiens
  misc_feature: GYAE6OF02I68EH.43.33.C11.1.454.CMB.1.raw
tcagtgtgagtagtcacgaccggtgctcgatttagagtgagctcgttgggtttgggggaagtctctctcagtcaggacacagcaagtggacatgagggtccctgctcagctcctggactcctgctgctctggctcccagattccagatgtgacatccagatgacccagtcgccagcctccctgtcctgcaaggtgtgggagacagagtctacccgtttttggccgggacgacgtccggccctattgacgacttggtttggccttggtatcggcgtgacgacccgagggacaacctcctctaaacttcctgtatacttaccggttcatcgactgttcgctacggttggggtaccctactcggttcagtggaccaacggctacgtgagacagttacttttctctcgtactatctacgttcggtctacgtacgtcttcggaacgtaccggaccgacgtaacgttacgtttacttccgttaggtacctaaacctacgttactcggtaccccttcccttacccccccttaagttaacccgttttccgggtacggtaaccgggtaaaccgtaaggttaccgaacgtaagttaccgaaacgttaccgaaacgttggtcggtaccgtcgtacccgaacctacttcgttacgttacgtttaccc

SEQ ID NO: 273280 - DNA, 551 bp, Homo sapiens
  misc_feature: GYAE6OF02HM874.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctcctgtctgcaagtgtggagacagagtctacctttttgccgggcgagtcggcccattgacgactgttggcctggtatcgcgtgacgacagggccacctcctcaacttctgatactaccgttcatcgtctgttgcgtacggttcgggtcccacgttcggtcagtcggcaacggtctctgagactagttacttttctctcgtctactctacgttcggtactacgtacgttctcgaacgacggcgactaagttcgttacttctgtacaactactatccgtcccttccctacccctaactacgtttccggacgacggacctagttacactatacgaactacgtacgtcgtcgctcgaccacgtactcgttctcgttacc

SEQ ID NO: 273281 - DNA, 580 bp, Homo sapiens
  misc_feature: GYAE6OF02IBGJZ.43.33.C11.1.454.CMB.1.raw
  modified_base (407)..(407): a, c, t, g, unknown or other
  misc_feature (407)..(407): n is a, c, g, or t
tcagtgtgagtagtcacgaccggtgctcgatttagagtgagctcgttggggtttgggggcagaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtctacccgtttttgccgggcgagtcggcccattgacgactgtttggcctggtatcgcgtgagaccgacgggcaacctcctactaacttctgaatactaccgttcatcgcttgttgcgtacggttcgggtcccacgtcggttcagtggctaacgctctgagactagtatttttctcttcgtctatctacgtggtctaacgngttctagacgacggcgactaagtcgttacttcgtagtacaactactactcgtaccctcccttaccccctaataacgtttcggtaacgacggggtaacctaaggttacgaaactgtaacctaagttaccgtaacgttggtccgtacgtaccgaccgaaccttacgttcttaccg

SEQ ID NO: 273282 - DNA, 549 bp, Homo sapiens
  misc_feature: GYAE6OF02IE0NR.43.33.C11.1.454.CMB.1.raw
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (502)..(502): a, c, t, g, unknown or other
  misc_feature (502)..(502): n is a, c, g, or t
  modified_base (532)..(532): a, c, t, g, unknown or other
  misc_feature (532)..(532): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtggagacagagtctaccctttttgccgggcgagtcggcccattgacgacttgtttggcctggtatcgcgtgagacagggcaacctctcaacttctgatataccgttnatcgctgttcgctacgttcgggtcctacctcggttcagtggcaacggtctctgagactagtatttttcnctcgtcatctacgtggtctacgacgttctcggacgtacggccgtactaaagttcggttaactttcgttacgtacaactactatcgaccctcccgtaccccctagtacttccggtacaggacctaagttcaactntacaagtccgaagtgtacgctcggccaacngttaccttgtacttccg

SEQ ID NO: 273283 - DNA, 631 bp, Homo sapiens
  misc_feature: GYAE6OF02GNGAW.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagccctccctgtctgcaagtggtgggagacagagtcctaccctttttgccgggcgagtcggcccattgacgactgttggcctggtatcgcgtgagaccgagggccaaccctcctactaacttctagatactaccgttcatcgctgttcgcgtacggttcggggtccctaccgttcggttcagtcggcgaacggctcgtgagactagttattttctcttcgtctactcgtacttggtctacgtagtctacggacgacggccgactaacgttcgttaacctttcgtacggtaccaaaccgtacttacttccgtaccccttaccccttacccccttaaacgttaaccgttttccgggtaaccggtaacgggggtaacccttaaggttaccgaaactacgttaacctaacgtaccgttaacgttggtacgggtcctacggacccaccgtacttcttaccg

SEQ ID NO: 273284 - DNA, 666 bp, Homo sapiens
  misc_feature: GYAE6OF02JS3OO.43.33.C11.1.454.CMB.1.raw
tcagtgtgagtagtcacgaccggtgctcgatttagagtgagctcgttgggtttgggggtcgagaagtctctctcagtcaggacacagcatggacatgagggtccctgctcagctcctggactccctgctgctctggctcccagattcccagatgtgacatccagatgacccagtcgccagcctccctgtctgcaagtgtggagacagagtctaccctttttgccggcgtagtcggcccattcgacgactgtttcggccttggtactcgcgtgacgaccgagggccaaccgtccctcaaccttctgatactacccgttcactacgtctgttgctacggttcgggtcccctaccgtccgttcgacgttggaccaacggtctcgtcggaacgtacgacgttacttttacgtcctcgttactacgtccgtaacttggtaccttacgacgttcgttacgtaccggtaccggtccgtactaacgttgttaccttacgttcgtaccgtaaactacgttactaccgtcccttacccgttccccccttaacgttaaccgtttccggtacgtaacggggtaccctacgttacgtaaccgtacttacctaaacgttcccgtaaacgttcggttacggttaccgtacggtaaccctaccttaccgttcgtttacccgg

SEQ ID NO: 273285 - DNA, 561 bp, Homo sapiens
  misc_feature: GYAE6OF02HXJ4V.43.33.C11.1.454.CMB.1.raw
tcagtgtgagtagtcacgaccggtgctcgatttagagtgagctcgttggggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttcggccgggtcgacgtcggcccattgacgtacgtgtttggcctggtatcgcgtgagaccagggcaacctcctcaacttctgatataccgttcatcgtctgttgctacggttgggccctacgtcgtcagtgcaacggtctcgtgagtacagttattttctcttcgtactactctacgttgggtccttaatacgtcgtaggaccggtacggccgtactaagttcgttacttctcgtacaacactatcgtaccctcctccccctataccgttcggtaccgtacgggacctagttacgaactataccgtaaagtccgaacttggtgtcctgaccacctatcttacg

SEQ ID NO: 273286 - DNA, 607 bp, Homo sapiens
  misc_feature: GYAE6OF02GEN8D.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggccattgacgactgttggcctggtatcgcgtgagaccagggcacctcctcaacttctgatactaccgttcatcgctgttcgctacggttcggggtccctaccgttcggttcaggtcggaccgaacggtctcgtagagacgtagttactttttcctacttcgtactattcaccgttggtctaacgtagttctggaccggtacggacgactaattcgtactttactgtactaacctattactcgacccttccctaccccccttagttaaccgtttccgggtacgaccgggtaacccgtaagttacgactacgttacctaacgtaccgtaaaccgtggtacgtcgtacggcctaacccgtagttccttcgttactttacccg

SEQ ID NO: 273287 - DNA, 653 bp, Homo sapiens
  misc_feature: GYAE6OF02F4ZUS.43.33.C11.1.454.CMB.1.raw
  modified_base (201)..(201): a, c, t, g, unknown or other
  misc_feature (201)..(201): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagacttccagatgtgacatccagatgacccagtcgccagcctcctgtctgcaagtgtggganacgagagtctacccgtttttggccgggacgtacggtccggccctagttcgacgtacgttggtttcggccgttggtactcggcgtagacgaccgacgggccaaccgttcctactaacttcgtagtaactacttaccgttcactccgtacgttcgttcgcgtacgggttcgggtaccctaccgttcggtcgtaggtcggaccgtacgtcgtcgtagacgtacgtagtttacttttccgtcgtcgttactaactcctaacggtgttacctactcgtccgtaggaccggcggtctacgtaacttcgttacctcgttacgtaactaacgtactacttccgtccccttaccccttaccccttaactaacgtttcccggtaccgaacgggttacctagttcgtaaaccgtattaaccgaagtaccgtactggtcgtacctacgcctactcgttctaccg

SEQ ID NO: 273288 - DNA, 527 bp, Homo sapiens
  misc_feature: GYAE6OF02GUCMC.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggccattgacgactgtttggcctggtatcgcgtgagaccagggcaacctcctcaacttctgatataccgttcatcgctgttgctacggttcgggtcccacgttcggttcaggtcggcaacggtctctgagacagtattttcctctcgtctatctactggtctactgtctggacgacggcgacatgtacttctgtacactactatcgccctcctaccccctactacgttccggacgacgggacctagtcgtaacactactaactacgtaactggtacgctcgaccacgtatcgttcg

SEQ ID NO: 273289 - DNA, 828 bp, Homo sapiens
  misc_feature: GYAE6OF02JT4XZ.43.33.C11.1.454.CMB.1.raw
tcagtgtgagtagtcacgaccggtgctcgatttagagtgagctcgttgggtttgggggtaaggtcgtctctcagtcaggacacagcatggacatgagggtcctgctcagctcctgggactcctgctgctctggctcccagacttccagatgtgacatccagatcgacccagtcgccagccctccctgtctgcaagtgtgggagacagacgtcctacccgttttggccgggtcgacggtccggccctagttcgacgtacttggtttcggccgttggtactcggcgtcggacgtaccgacggggacctaacccgtcctacctaacgttcctaggtacttaacgtacccggttactacgtccgtccgttgttcgtaccgtaccgggtttccggggtaccctaccggttccggttacacgggtaccggtacgtaaaccggtccgttacgtacggaacgtaacgtacggttttacctttttccggtaccgtttacggttacctacgttaccgtaacccggtttggtttaccccgtaacgttaaccgttcccggttaaggtaacccgggtaaccggtacccgtaacttaacgttaccggtttacctttaccgggttacgttaaccctaaaaccggtactttaaccgttcccgttacccccgttaccccctttaaccccccggttaaacttaaaccggttttcccggtaaacccggttaaacgggtaaacccttaacgggttaccgtacctaaccgttacgtaaaccgtacgttaaccggtcggttacgtacccttacggtaccaaccttacgttcccgttgttacccttaccgg

SEQ ID NO: 273290 - DNA, 529 bp, Homo sapiens
  misc_feature: GYAE6OF02FQDHR.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccagttgacgactgtttggcctggtatcgcgtgagaccagggcaacctcctcaacttctgatataccgttcatcgtcttgttgctacggttcgggtcccaccttcggttcagtcggcaacggctctgagacagtattttctctcgtcatcactgtctactgtctgaccgacggcgacatgttacttctgtacaactactatcgtcccttcctcccccttataactttccggactacgggacctagttacgaactatactaacgtaccgaagttggtacgcgtagcacctatctacg

SEQ ID NO: 273291 - DNA, 672 bp, Homo sapiens
  misc_feature: GYAE6OF02I7SOX.43.33.C11.1.454.CMB.1.raw
  modified_base (403)..(403): a, c, t, g, unknown or other
  misc_feature (403)..(403): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtctacctttttgccgggcgacgtcggcctattgacgacttgttggcctggtatcgcgtgacgaccgagggaccaacctccgtactaaccgttctagtatactaccgttcactccgcttgttcgcgtacggttcggggtaccctaccgttcggttcaggtcggaccgtaacggcttcgtagacgtactagttactttttcncttacgtctatcacgttggtactacgtgtcgtgacggtacggccgtactaacgttcgttacctttcgtacgtacctaactaccgttagttccgtacccctttccccgtaccccccttaaagtttaccgttttacccgggtacggtaaccggggttaaaccctaacgggtttacgtaaccgtaacgttaccgtaaacgttacccgtaacgttccggtacggtccgttacggtaccctaccgtacgtttacccgttcgttacccgtttacc

SEQ ID NO: 273292 - DNA, 795 bp, Homo sapiens
  misc_feature: GYAE6OF02IJV99.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctccgtgggacctcctgctgctctggctcccagacttccagactgtcgacactccagatccgacccagtccgccacgcccttcctcgtctcgacgtaagtggtacggacgaacgcgttaacgtccccgttttacccgtttttcgggcccgggtacgtacggttcccggcccgtagttcgaaccgtccgtttgggtttccggccgttagggttaccgtccggtcggtagaccggaaccggtacgggacctaaccctccgtacctaaaccttctaagtacttaccgttaccgttcacgttccgtcgttacgttcgccgttaccggttcccggggtaccctcggttaccgtcgacgggtccgacctaccggtctacgtacggaacgtactttacgtttacgtttttccgccccgttacgtaacgtaccgttaccgtaccgttcgttaccgttaaccgttacgttaccggtaccgtaccggtaccggtaccgtaccgtaacgttacgttaccgtttcgtacgtacctaacctacgtaccgtccgtccccttaccctaccccttaccgaccgttttttttttttaccgacggtaaccggtaccgtaacgtacgtactacgttacgtaacttacgtacgttcggttacgttacgtaccgtacctaccgttacgttcgttaccgttacttacccg

SEQ ID NO: 273293 - DNA, 554 bp, Homo sapiens
  misc_feature: GYAE6OF02G355V.43.33.C11.1.454.CMB.1.raw
  modified_base (417)..(417): a, c, t, g, unknown or other
  misc_feature (417)..(417): n is a, c, g, or t
  modified_base (468)..(468): a, c, t, g, unknown or other
  misc_feature (468)..(468): n is a, c, g, or t
  modified_base (509)..(509): a, c, t, g, unknown or other
  misc_feature (509)..(509): n is a, c, g, or t
  modified_base (541)..(541): a, c, t, g, unknown or other
  misc_feature (541)..(541): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtggtgggagacagagtctaccctttttgccgggcgagtcggccattgacgactgtttggcctggtactcgcgtgagaccgagggcaacctcctcaacttctagatactaccgttcatcgcttgttacgctacggtttcggggtcccctacgttccggttcaggtcggacaacggcttacgtgacgtactagttactttttctcgttcgtctatcacgtcggtctacngttctagacgacggcgacgtaattcgttacttctacgtacaactcttaacncgtccctacctcccctaatacgttcgacgacggactagttnactctactaagtcgaatcgtcgctgccacctntcgttatccttac

SEQ ID NO: 273294 - DNA, 564 bp, Homo sapiens
  misc_feature: GYAE6OF02GA5RZ.43.33.C11.1.454.CMB.1.raw
  modified_base (376)..(376): a, c, t, g, unknown or other
  misc_feature (376)..(376): n is a, c, g, or t
  modified_base (452)..(452): a, c, t, g, unknown or other
  misc_feature (452)..(452): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtggagacagagtcacccttttgccgggcgagtcggcccagttgacgactgtttggcctggtatcgcgtgagaccagggcacctcctcaacttctgatactaccgttcatcgctgttcgcgtcgttcggggtccctaccgtcggttctagtcggacaacggctcgtgacgactagtatttttccncttcgtctagtctacgttcggtctactggttctgaacggacggcgacaagttcgttacttcgtgtaccaactactntcgtccttccctacccctataccgtttccggtaccagggtaacctagttacgtacactataacgtaccgaacgttggacgtctcgacctacctctccgttagttccttaccg

SEQ ID NO: 273295 - DNA, 653 bp, Homo sapiens
  misc_feature: GYAE6OF02G3RPZ.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatcgacccagtcgccacgccctccctgtctgcaagtgtgggagacagagtctaccgttttcggccgggcgagtccggccattcggacgtacgttggttcggtccgtggtactcgcgtgacggaccgacgggaccacctcctactaaccttctagtactacttaccgtcactcgtcttgttcgcgtacggttcggtccctaccgttcggttactacggtcgacgacggcctcgtaggacgtactagtttactttttcgtccgtacgttactactctacgttcggttacttacgtacgttcgtacggaccggtaccggcgacgttaacgttacgttactttccgtacgtaccaacctaccttaacgtccctacccttacccctacccccgttaacttaacgtttccggtaccgtacgggaacctaacggttaacgaactactaactaacgtaccgtaacgttcggtaccgtacgtacgtacctacgtaccg

SEQ ID NO: 273296 - DNA, 690 bp, Homo sapiens
  misc_feature: GYAE6OF02GDNZM.43.33.C11.1.454.CMB.1.raw
tcagtgtgagtagtcacgaccggtgctcgatttagagtgagctcgttggggtttgggggaagtctctctcagtcaggacacagcatggacatgagggtccctgctcagctcctgggactcctgctgctctggctcccagattccagatgtgacatccagatgacccagtcgccagcctcctgtctgcaagtgtgggagacagagtctaccctttttggccgggcgagtccggccctattgacgtacttgtttggcctggtatcgcgtgagaccagggcaacctcctacaacttctagatactaccgttcatcgctgttgctacggttcggggtccctaccgtcggttcgagtcggacaacggtctacgtaggacgactagttactttttccgtcttcgtactactaccgtacgttcggttacctaacgtacgttcttacgggaccggtaccgggaccgtactaaagttcgtttaccgtttcgttcgttaaccaaactacttaacgtccgttaccccttaccccgtttaccccccttaaacgttaaccgtttttacccgggtaaccggtaaaccgggggttaaccttaaacggtttaccgaaccgttaacgtacgtaaacgttaccgttaacggttacgtaccgggttactacggtaccctaaccttacgttccttccggttcgtttaccc

SEQ ID NO: 273297 - DNA, 538 bp, Homo sapiens
  misc_feature: GYAE6OF02F7QX7.43.33.C11.1.454.CMB.1.raw
  modified_base (349)..(349): a, c, t, g, unknown or other
  misc_feature (349)..(349): n is a, c, g, or t
tcagtgtgagtagtcacgaccggtgctcgatttagagtgagctcgttggggtttggggggcagaagtctctctcagtcaggacacagcatggacatgagggtccctgctcagctcctgggactcctgctgctctggctcccagattccagatgtgacatccagatgacccagtcgccagccctccctgtctgcaagtgtgggagacagagtctaccctttttgccgggcgaggtccggccattgacgactgtttggcctggtatcgcgtgagaccagggcaacctcctcaacttctgatactaccgttcatcgcttgttgctacggttcgggtccctaccgtcggttcnggtcggcaacggtctctagagtacagtacttttctctcgtctactctactgtctactgtctcgacgacggcgacatgtactctgtacaactactatcgtccctccttacccctactacttccggtcgtacgggacctagtcgtaacgtctacaactacgtaacgttggtcgtactgccacctattctcg

SEQ ID NO: 273298 - DNA, 562 bp, Homo sapiens
  misc_feature: GYAE6OF02G6NUG.43.33.C11.1.454.CMB.1.raw
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (552)..(552): a, c, t, g, unknown or other
  misc_feature (552)..(552): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggcctggtatcgcgtgagaccagggcaacctcctcaacttctgatactaccgttcatcgctgttgctacggttcggggtcccaccgttcggttcaggtcggcaacggctcgngagactagtactttttcncttcgtctatcactggtctacagttctagacggacggcgactaagttcgttacttctgtaccaactactactcgaccccttccctacccccttaatacgtttcgaccgtacgggaacctaagttcgaactataccaagttaccgaacgtggtcgctacgcctaacgtcttccttnttcccttacg

SEQ ID NO: 273299 - DNA, 629 bp, Homo sapiens
  misc_feature: GYAE6OF02JER1R.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagacgtctacccgtttttgccgggtcgaggtccggccattgacgactgttggcctggtatcgcgtgagacgagggccaacctcctctaacttctgatactacgtcatcgctgttgcgtacggttcgggtccctaccgtcggtcaggtcggacgtaacggcttcgtagacgtactagttactttttacctcttacgtctattccgtaacgttcggtactacgtacgttcgtaggtaccggacggtccgtaacgtaagttcgttaaccttcgttacgtaccgtaaactacgttactccgacccttcccttacccccgttaacttaacgtttccggtaacgacggggtaacctaaggttacgaaccgtacttaaccaacgttaccgaacgtttcggtacggtcctaccgacctaccctattccgttacg

SEQ ID NO: 273300 - DNA, 662 bp, Homo sapiens
  misc_feature: GYAE6OF02HEJ9Q.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatcgaccagtcgccacgcctccctgtctgcaagtggtgggagacgagacgtcctacccgtttttggccgggtacgacggtccggccctagttcggaaccgacgtttggtttcggccttggtacgtcgcgttggacgaccgagggtaccaaccctcctacgtaacttcgtagtactacttaccgttacactcgtcttggttcgacgtacggttcgggtacccctaccgttcggttacgcggttacggcctaacggtcctacgtagacgaactacgttacttttcctcgtccgttactacttactaccgtacgttacctacgtgttccgacgtaacggccgacgtactaacgtcgttacctcgttacacctaactactacgtccgtacctaccccttacccctacttacgttcggtacccgtacgggtacctacggtaactaactacgttaaccgaacgttacgtaaccgtcggttcgtaccgtacgtacctaccgtacg

SEQ ID NO: 273301 - DNA, 616 bp, Homo sapiens
  misc_feature: GYAE6OF02F4J62.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctcctgtctgcaagtggtgggagacagagtcctaccctttttgccgggcgagtcggccctattgacgactgttggcctggtatcgcgtgacgcagggcaacctcctcaacttctagatactaccgttctactcgtacttgttagcgtacggttcggggtccctacgtcggttcagtcggactacggtctcgtgagacagtattttcgtctcgtacactcgacgttcgtactactacgtctacggacgaccgggtcactaagttcgtacgtttcgcgtaccgtaaactcttaacgtcgtacccgttacccctacccccttaataaccgtttccgggtacgtaaaccgggtaacccttaaagttcgaaccttaagtacctaaaggttaccggtaacttggtacgtcttaccggcctacccgtattccgttgtaccctttaccg

SEQ ID NO: 273302 - DNA, 546 bp, Homo sapiens
  misc_feature: GYAE6OF02FUEPH.43.33.C11.1.454.CMB.1.raw
  modified_base (326)..(326): a, c, t, g, unknown or other
  misc_feature (326)..(326): n is a, c, g, or t
  modified_base (394)..(394): a, c, t, g, unknown or other
  misc_feature (394)..(394): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
  modified_base (534)..(534): a, c, t, g, unknown or other
  misc_feature (534)..(534): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcaccctttttgccgggcgagtcggcccattgacgactgtttggcctggtactcgcgtgacgaccgagggcaacctcctactaacttctgatacttaccgttctatcgcttggttncgtacggttcgggtccctaccgttcggttcaggtcggacaacgggctcgtgacgacagttacttttcncttcgtctactctacgttggtctacagtctgacgcgcgacagtntacttntagtacaactctacnctcctcctacccctattacgttccgtagacggtacctaggttacaactacgtacaacgtacgactcggtacgtcncgtacacttacg

SEQ ID NO: 273303 - DNA, 693 bp, Homo sapiens
  misc_feature: GYAE6OF02GOU5U.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtcgccacgcctcctgtctgcaagtgtgggagacaggagtcctacccgtttttgccgggcgacggtccgaccctagttcgacgtacttggtttacggccttggtacgtcgcgtgacgaccgagggacctaacctcctaccgtaaactttcgtacgtacttaacgttacccgttacacttcgtcttggttacgtccgttaaccgggtttccggggtacccctaccggtacggttcctaaggtcggtaccgaacggtcttacgtacgaacggtaccttaagtttacctttttcctaccgttcgtacacttcgtaccgttacggtaccttaacgtacgttccgtacgaccggtaaccgtccgacttaagttacgttaccttacgtacgtacctaactaacgtaactccgtaccctttaccctacccccttaagttaccgtttaccgtacgaacggtaacgtaagttacgactaactacgtaactaaccgactcgtcgtacacgtacaaccttcgtcttccgtattaccg

SEQ ID NO: 273304 - DNA, 810 bp, Homo sapiens
  misc_feature: GYAE6OF02G2LGU.43.33.C11.1.454.CMB.1.raw
  modified_base (218)..(218): a, c, t, g, unknown or other
  misc_feature (218)..(218): n is a, c, g, or t
  modified_base (752)..(756): a, c, t, g, unknown or other
  misc_feature (752)..(756): n is a, c, g, or t
  modified_base (758)..(758): a, c, t, g, unknown or other
  misc_feature (758)..(758): n is a, c, g, or t
  modified_base (760)..(761): a, c, t, g, unknown or other
  misc_feature (760)..(761): n is a, c, g, or t
  modified_base (763)..(764): a, c, t, g, unknown or other
  misc_feature (763)..(764): n is a, c, g, or t
  modified_base (766)..(767): a, c, t, g, unknown or other
  misc_feature (766)..(767): n is a, c, g, or t
  modified_base (769)..(773): a, c, t, g, unknown or other
  misc_feature (769)..(773): n is a, c, g, or t
  modified_base (775)..(775): a, c, t, g, unknown or other
  misc_feature (775)..(775): n is a, c, g, or t
  modified_base (777)..(777): a, c, t, g, unknown or other
  misc_feature (777)..(777): n is a, c, g, or t
  modified_base (784)..(785): a, c, t, g, unknown or other
  misc_feature (784)..(785): n is a, c, g, or t
  modified_base (787)..(787): a, c, t, g, unknown or other
  misc_feature (787)..(787): n is a, c, g, or t
  modified_base (790)..(790): a, c, t, g, unknown or other
  misc_feature (790)..(790): n is a, c, g, or t
  modified_base (792)..(793): a, c, t, g, unknown or other
  misc_feature (792)..(793): n is a, c, g, or t
  modified_base (795)..(797): a, c, t, g, unknown or other
  misc_feature (795)..(797): n is a, c, g, or t
  modified_base (799)..(799): a, c, t, g, unknown or other
  misc_feature (799)..(799): n is a, c, g, or t
  modified_base (801)..(801): a, c, t, g, unknown or other
  misc_feature (801)..(801): n is a, c, g, or t
  modified_base (803)..(803): a, c, t, g, unknown or other
  misc_feature (803)..(803): n is a, c, g, or t
  modified_base (806)..(808): a, c, t, g, unknown or other
  misc_feature (806)..(808): n is a, c, g, or t
tcagtgtgagtagtcacgaccggtgctcgatttagagtgagctcgttggggtttggggggcagaagtctctctcagtcaggaccacagtcatggtacattggagggtccctgcgtcagctcctgggactcctgctgctctggcctcccagtattcctagtatgtgactaatccagatgacccagtcgccacgcctccgtgtctgacgaggtgtggganacgagtacgtcctaccttttcggccgggtcgtacggtccggccctagttcgaccgtacgttggttcggtccgttggtactcggtcgtgacgaccgacgggtcctaacccgtccgtaccgtaaccgtttccgtacggtaagttaaccggtttaccccggttacgtaacgttccggtaccgtttacgggtttacggtacccggttacccgggggttttacccggggggttaccccccgttaacccgggttttacccgggggtttaacccgttaaccgggggttaaccggggtaaccccggttaaaccccggggttaccccggttttaaccgggttaaaccggggtaaacccgggttaaaaccccgttttaacggggttttaaaacccggtttttttttttcccccgttttaacccccggggtttttttaacccccggttttaaacccgggttttaaacccgttttaaaccccccgggggttttttaaaaacccccccggggggtttttttttaaaacccccggggggggttttttnnnnncngnntnntnnannnnncncnccatctnngntgnannannnangncngcnnntc

SEQ ID NO: 273305 - DNA, 644 bp, Homo sapiens
  misc_feature: GYAE6OF02FHG6K.43.33.C11.1.454.CMB.1.raw
  modified_base (379)..(379): a, c, t, g, unknown or other
  misc_feature (379)..(379): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgaccagtcgccagcctccctgtctgcaagtgtgggagacagagtctaccctttttgccgggcgagtccggccctagttcgacgacttggtttcggcttggtatcgcgttcgagaccgagggcaaccgtcctccaacttctgatataccgttcaactcgtcgtgttcgccgtacgttcgggggtcccaccgttcggttctaggtcggctaaccggctcgngtacgaactaggttacttttcctcgttacgtctatcctacgtcggtactactacggttctcggtaacggaccggtcgactaaacgttgtacctttcgtagttccgaactactaacgttccgaccttacccctccccccgttaattaaccgttttccgggtaccgtacggggtaaccctaaggttaccgtaactacgtacctaaacgtccgtaaacgttcggacggtcgttacggaccctaaccggattccgtcgttacctacccg

SEQ ID NO: 273306 - DNA, 675 bp, Homo sapiens
  misc_feature: GYAE6OF02JC1RK.43.33.C11.1.454.CMB.1.raw
  modified_base (398)..(398): a, c, t, g, unknown or other
  misc_feature (398)..(398): n is a, c, g, or t
tcagtgtgagtagtcacgaccggtgctcgatttagagtgagctcgttgggttggggggcagaagtctctctcagtcaggacacagcatggacatgagggtccctgctcagctcctgggactcctgctgctctggctcccagattccagatgtgacatccagatcgacccagtccgccacgccctccctgtctgctaaggtgtgggagacagacgttctaccgtttttcggccgggtcggtacggtccggcctagttcggacgtacgttggtttcggccgttggtatcggcgtgacgaccgagggcctaaccctcctactaaccttcgtagtaacttacttaccgttcacgtcgtcttagttcgccgtacggttccgggtccctaccggttcggttcgnggtcgaccgtaaccggtctcgtagagactagttacttttctcgtcgtctactcgtacttggtctacgtgttctacggacgacggtccgaacttagtacgttaccttcgtacgttaaccaaactacgtacgtccgtcccttccccgttacccccttaacgttaccgtttaccggtaccggtaccgggtaacctacgttaacgtaaccttactaacgtaacgtaccgtaacgttcggttacggtccgtaaccgtcccgaaaccttccgttacgttcccg

SEQ ID NO: 273307 - DNA, 663 bp, Homo sapiens
  misc_feature: GYAE6OF02H1IU9.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggcctcccagattccagatgtgacatccagatgaccagtcgccagcctccctgtctgcaagtgtgggagacagacgtctaccctttttgccgggtcggacgtcggcccattgacgacttgtttcggcctggtactcgcgtgacgaccgagggcaacctcctcaacttctagatactaccgttcatccgtctgttcgcgtacggttcgggtcccctaccgttcggttcgagtcggacctaacgggtcctacgttcggaacggtactaagttaccgttttttcgtccgttaccgttctacttacctacgttcggttaccttactgttcgtggtacggaccggacgtactaagttacgttcctttacttacgtacaacgtaaccttacgtccgtacccttaccctacccccttaacgtaacgtttccggtaccgaacggggtaaccaagtttacgaactacgtacgaaacgttaccgtaacgttcggtacggtccgtacggaccacccgtactttacctcggtttaccctttacccg

SEQ ID NO: 273308 - DNA, 630 bp, Homo sapiens
  misc_feature: GYAE6OF02HUGXM.43.33.C11.1.454.CMB.1.raw
  modified_base (373)..(373): a, c, t, g, unknown or other
  misc_feature (373)..(373): n is a, c, g, or t
tcagtgtgagtagtcacgaccggtgctcgatttagagtgagctcgttggggtttgggggaagtctctctcagtcaggacacagcatggacatgagggtccctgctcagctcctgggactcctgctgctctgctcccagacttccagatgtgacatccagatgacccagtccgccagcctcctgtcctgcaagtgtgggagacagagtctacctttttgccgggtcgagtcggcccattcgacgactgtttggcctgtatcgcgtgacgtaccgaggcaaccgtctactaacttctgatactaccgtcactcgactgttgcctacggttcgggtccctaccgtcggttacaggttcgcaacggctctagagtanagttattttcgtctcgtacattacactggttcctacgtagttcctaggaaccgtaccggactaacgtaaacgttcgtttaaccttcgtagttaaaccaaaccgtaactctaccggtaccccttcccgtaacccccttagtaaactttccggggacgtaaacgggtaacctaaggtaccaacttaacgtactaaaggtaccttaacggtcggttaacgcctacggaccctaaccttagtaccttcggtacttaacccg

SEQ ID NO: 273309 - DNA, 699 bp, Homo sapiens
  misc_feature: GYAE6OF02JUXYE.43.33.C11.1.454.CMB.1.raw
tcagtgtgagtagtcacgaccggtgctcgatttagagtgagctcgttgggtttgggggtcgagaagtctctctcagtcaggacacagcatggacatgagggtccctgctcagctcctgggactcctgctgctctggctcccagattccagatgtgacatccagatcgacccacgtcgccacgccctccctgtctcgcaacgtgtgggacgacagagtctaccctttttcgccgggtcgacggtcggcccagttcgacgtacttcggtttcggccgttggtactcgcggttggacgtaccgacggggaccaaacccgttcccgtacctaaacctttccgttaggtaacttaacgttaaccccggttacaacttccgtccgttaggtttcggaccgttaccgggtttccgggggtaccccctacccgtttccggggttacacgggttcgggaccaaaccgggtctcgttgaacgactagtttacttttcgtccttcgtactactctacgtcggtacctacgtacgttctaggaaccggtcggaccggtactaacgttcgttaccttcgtacgtacctaactacgttactcgtccctccccttaacccctacttacggtttccgacggtacgggtacctacgttacgacctaacttacaaacttccggaacgttcgtacggcctacgaccaacctctcttcg

SEQ ID NO: 273310 - DNA, 858 bp, Homo sapiens
  misc_feature: GYAE6OF02GFDFN.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccacgcctcctgtctgcaagtgtgggagacagacgtctacccgtttttgccgggtcgtacggtccggccctagttcgaccgtacgttacggtttcggccgttaggttactccggtcgttgacgtaccgagggacctaacccgttcctaccgtaacctttcgtacgtaacttaacgttaccccggtttactaacgttccgtacgtttcggtttacgtaccggttaaccgggtttccgggggttaccccctacccggtttaccgggttaccggtacggttccgggtaccgtaaccggtccgttacgtacggtaacgtaaccgtacgtttacgttttttacccgttacgttaccggttactaaccgttcccgtaaccgtttacggtttacccgttaaccgttacggttccgttaacgggaacccggtaccgggtacgtaaccgttaagtttacggttaccctttacgttaccgtaacctaaaccctttacgttacgttacccggtaccccctttcccgttaacccccccgtttaacgtttaacccggttttccgggtaaaccggtaaccggggttaacccgtaacgggtttaccgaaaccgttacgttaaacctaaccggttaaccgttaacgttacggtaccgggtactttaaccgacccttaaccggttacgttacccgtttaccg

SEQ ID NO: 273311 - DNA, 731 bp, Homo sapiens
  misc_feature: GYAE6OF02HVXNE.43.33.C11.1.454.CMB.1.raw
  modified_base (183)..(183): a, c, t, g, unknown or other
  misc_feature (183)..(183): n is a, c, g, or t
  modified_base (189)..(189): a, c, t, g, unknown or other
  misc_feature (189)..(189): n is a, c, g, or t
tcagtgtgagtagtcacgaccggtgctcgatttagagtgagctcgttgggtttgggggtaaggtctctctcagtcaggacacagcatggacatgagggtccctgctcagctcctgggactcctgctgctctggctcccagattccagatgtgacatccagatgaccacgtcgccacgcctccncgtctncaagtggtggagacagagtctaccttttcgcggccgagtccggcctatcgacgatgttcggccgtggtatcgtgtagacgacgacgggctaaccgtcctactaaccgtctaggtaacttaacgtaccttccgtaactccggctttcgttacggccgttaaccgggtttcgggggttacccccgtaacccgtttccggttacccggtagggtaccgggtaccgtaaacgggtccgttcttacggaacggtaaccctagttaaacgtttttcttcgtccgttactacgttacctacgtccggttaccgtaacgtacgttacttacggaacggtaaccgggcgtaccgtaaagttcgtttaaccgttcgtaccgttacgtaaactacgtaacgtaccgtacccttccctaaccccccttactaaccgttttcggtaaccgggaacggtaacccaaggttaccgaaacttacgtacgtaaaccttacgaacgttcggacggtaccgttacgaccgtaacctactttccgtacgtttacttaacccg

SEQ ID NO: 273312 - DNA, 655 bp, Homo sapiens
  misc_feature: GYAE6OF02F7QFT.43.33.C11.1.454.CMB.1.raw
  modified_base (459)..(459): a, c, t, g, unknown or other
  misc_feature (459)..(459): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagcagtacttccagatgtgacactccagactcgacccagtccgccacgcccttcctgtctgacgtaggtggtagggacgacgagtacgttccttaccgttttcggccgggtcgtacggtccgacctagtcggacgtacgttcggttcggccgttggtacgtcggcgtagacgtaccggacggtacctaaccgtcctactaccttcgtagtaacttacttaccgtactacgtcgtcttggtacgtcgtacgggttccggtcctacggttcgtcgtacggtacgacgtacggtctacgtacgagtacgttactttcgttcncttcgtactacgtctacgttcgtactaggtctacgacggacgtacgactacttacgttacttcttactactacctaacgtcttacgtcccttacccgtaccccttaccgtacttacgtaccggacggtacggtactaacggtactaaccgtataaccgtacgtactacggtcgtaccgtactccgtactacttacg

SEQ ID NO: 273313 - DNA, 587 bp, Homo sapiens
  misc_feature: GYAE6OF02IOOXG.43.33.C11.1.454.CMB.1.raw
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
tcagtgtgagtagtcacgaccggtgctcgatttagagtgagctcgttggggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggccttggtatcgcgttgaagaccaagggcaaccgtcctcaacttctgatataccgttcaatcgctgttgctacgttcgggtcccacgtgttcngtggcaacggctctgaagcagtatttttcncttcgtacatcacgtgtactacagtctcgacgacggcgctaagtgttaacttcgtgtaaccaaacgtacttatacgtcccttaccgtaccccccttaataacgttttaccggtcgtaaacggggaaccttaaagttacggaacattaaccaaagttaccggtaagttacgtcggtaccgtacgtaccgaaccctagtaccttcggtactttaccc

SEQ ID NO: 273314 - DNA, 660 bp, Homo sapiens
  misc_feature: GYAE6OF02JEJZT.43.33.C11.1.454.CMB.1.raw
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
tcagtgtgagtagtcacgaccggtgctcgatttagagtgagctcgttgggtttgggggtcgagaagtctctctcagtcaggacacagcatggacatgagggtccctgctcagctcctgggactcctgctgctctggctcccagattccagatgtgacatccagatgacccagtcgccagcctcctgtctgcaagtgtgggacgacagacgtctaccctttttcgccgggtcgtacgtcggaccctagttcgacgtacttgtttggaccgtggtatcgcgtcgngaccgngggacacctccgtactactctgatataccgttcatcgcttgtcgcgtacggttcgggtcccacgttcggttctaggtcggaccgaacggcttcgnggagacgtacgttatttttccnctttcggctactacgtacgttcggtcttaacgtacgttcgtacgaaccggtacggccgtacgtacgttacgtttctaccgttgaccgttaactacgttaacgtcgtacccttccccttacccccttaacgttaaccgtttccggttaccggtaaccgggtaaccttacggttaacgaaccgtaacgttaacctaacgtaccgttaaacgttcggtaacgggtctaccggacctaacccgtacgttacttaccgg

SEQ ID NO: 273315 - DNA, 766 bp, Homo sapiens
  misc_feature: GYAE6OF02FLYPT.43.33.C11.1.454.CMB.1.raw
  modified_base (203)..(203): a, c, t, g, unknown or other
  misc_feature (203)..(203): n is a, c, g, or t
tcagtgtgagtagtcacgaccggtgctcgatttagagtgagctcgttggggtttgggggcagaagtctctctcagtcaggacacagcatggacatgagggtccctgctcagctcctgggactcctgctgctctggctcccagattccagatgtgacatccagatgacccagtcgccagccctccctgtctgcaagtgtggganacagagtctaccctttttggccgggcgagtccggcccattgacgactgttggcctggtatcgcgtgagaccgagggcaacctcctacaacttctgatactaccgttcatcgtcttgttcgacgtacggtttcggggtacccctaccgttcggttacagggttacggaccgtaaccgggtcttacgtacgggtaacgtaaccgtaggtttaacttttttttcccgtacgttaccggtttacctaacgttacctaaccgttcgggtttacccttaccgtaacgttccttacggtaaccggtaccgggtaccgtacgaaacgttacggttaccttttacgtacgttaacccgtaaacctaaccgttaacttaccggtaccccttaccctttaccccccccgttaaacgttaacccgtttttaccgggtaacccggtaaccgggggttaaaccgttaacggtttaaccgtaaaccgtaacgttaacctaaaacgttaaccggtaaccgttaggttaccgggtaccttaaccggtaacccgtaacccgtaacgttcccgtttaaccgg

SEQ ID NO: 273316 - DNA, 595 bp, Homo sapiens
  misc_feature: GYAE6OF02FZUJ1.43.33.C11.1.454.CMB.1.raw
  modified_base (258)..(258): a, c, t, g, unknown or other
  misc_feature (258)..(258): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtccgccagcctccctgtctgcaagtgtgggagacagagtctaccctttttgccgggcgagtccggccattgacgctgtttggctggtntcgcgtgagacgagggccaacctcctctaacttctgatataccgttcatcgtctgttcgcgtacgttcggggtcccacgtcgttcagtcgacacggctcgtgacgacagttactttttctcgttcgtctactcgtacttggttacctacgtacgtcgttagaccggaccggtcgacgtaaagttcgttaccttcgtgtaccaacgtaacctagtccgtcccttcccgttacccccttaagttaaccgttccggtaccgaacggggtaacctaggttacgaactactaccgtaagtaaccggattggtcggtctccgacctaaccgtcttacgttacg

SEQ ID NO: 273317 - DNA, 538 bp, Homo sapiens
  misc_feature: GYAE6OF02H0AYJ.43.33.C11.1.454.CMB.1.raw
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctcctgtctgcaagtgtgggagacagagtctaccctttttgccgggcgagtcggccattgacgactgttggcctggtatcgcgtgagaccagggcaacctcctcaacttctgatactaccgttcatcgctgttgcacggttcgggtccccacgttcggttcagtggcaacggctctgagacagtnttttctctcgtcatcacgttgtctacngtctagacgacggcgactaatcgtactcgttcgtacaactactatcgcccttcctccccctaactaacgtttccggtacgacgggacctaaggtacaactaatactaacgtaccgtaacgtcggtcggtactcgacctacctacg

SEQ ID NO: 273318 - DNA, 564 bp, Homo sapiens
  misc_feature: GYAE6OF02IIQKC.43.33.C11.1.454.CMB.1.raw
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
  modified_base (461)..(461): a, c, t, g, unknown or other
  misc_feature (461)..(461): n is a, c, g, or t
  modified_base (512)..(512): a, c, t, g, unknown or other
  misc_feature (512)..(512): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccgtttttcgccggggcgagtcggcccattgacgactgtttggcctggtatcgcgtgagaccgaggcaaccctcctcaaccttctgtatagtaccgttcatcgtctgttcgntacgttggggtcccaccttcggttcagtcggtacaacggcctcgtagagacagttaactttttcncttcgtcatccacgttcggtactactagttcgttagacgacgggcggtacaagttcgtacttctgtacaacactangtccctaccctccccctaatacgttccgtcgacgggtaaccaagttacganactacgaactaccgtaatcggttagtctcgtaccacctatccttgtcttacc

SEQ ID NO: 273319 - DNA, 596 bp, Homo sapiens
  misc_feature: GYAE6OF02GP7E9.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttgccgggcgagtcggccattgacgactgttggcctggtatcgcgtgagaccagggcaacctcctcaacttctagatactaccgttcatcgctgttcgcgtacggttcggggtccctaccgttcggttctaggtcggcaaccggctcgtgacgactagtattttctcttcgtctatcaactggtactacgtagttctcggacgtacggcgtactaagttcgttacttcgtagtacaactattactcgacccttaccctaccccttataacgtttccgggtacgtaacggggtaacctaagttacgaactagtaccgtaaactaccggtaacgtcggttacggacttcggacctacccggtatttccgttacgttcgttaaccc

SEQ ID NO: 273320 - DNA, 805 bp, Homo sapiens
  misc_feature: GYAE6OF02IP6RI.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctggactcctgctgctctggctccagattccagatgtgactatccagatacgacccaggtccgccacgccctccctcgtcgtgactagtggtgggagactagacgttccttacccgtttttcgggcccgggtacggtacggtccggtacccgaacgttacggtaccggtacgtttcggttttcggtccggttagggttacgtccggtcgggtacggaggtaacccggaacgggtaccctaaacccgttcccgtaacttaacctttacgtacgtaacttaacgttaacccgtttacctaacgttccgtccgttggtttacgtccggttaaccggttacccgggtaccccgtaaccggtttccggttacgtacggttcggaccgtaaccggtcgttcgagtacgtacttaaggtttcttttactccgttcgtacctacttaacgacgttcggtacctacgttaggtcgtacggaccggtaccggtacgaaccttaacgttcgttacctttacgttacgtactaacgtacgttacgtacccgtacccttacccttaacccccgtactttaacggtttacccggtaaccggtaaccgggttaaccgtaggttaacgtaaccgtaacgtaaccttaaacgttaacgtacgtttacggacggttccgttaccggaacctaccgtacgttccttaccgg

SEQ ID NO: 273321 - DNA, 649 bp, Homo sapiens
  misc_feature: GYAE6OF02HCZPW.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctcctgtctgcaagtgtgggagacagacgtctacctttttggccgggcgagtccggccattcgacgtacttgttcggcctggtatcgtcgtgacgaccgagggccaaccgtcctacaacttctacgtacgtacttaccgttcacgtcgtcgttcgtcgtcgtacggttcgggtccctaccgttcgttcgagtcggacacggtctacgtgacgtacgtagttacttttcgtcttcgtactactcctagttcggtacctagtacgttacgtacgacgggtaccggacgtacgtaagtttacgttactttacgttcgtaacctaacgtacttacgtccgtccccttaccctacccccttaagttaaccgttttccggaacggtaaccgggtacctaaaggtaccgaactagtaccgtaacgtaccgtaacgttggtacgtaccgtcggaccctacgtcttcgtacgttacttacccg

SEQ ID NO: 273322 - DNA, 795 bp, Homo sapiens
  misc_feature: GYAE6OF02IWK5O.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacactccagatgacccagtcgccacgcctccctgtctcgcaagtgtgggagacagacgttcctaccgtttttggccgggtcgtacggtccggcccagtttacggacgtacgttcggtttcgggtcccttgggttacttccggcggttaggtaacggacccgaacgggggtaccctaaaccccgttcccttaccgtaaaaccttttcccggttaggtaaactttaaccgtttaacccggttttacccaacgtttacccgggtaccgtttcggtttacggtacccgttaaccggggttttcccggggggtttacccccctaacccggttttccgggtttaccggtacggttcgggtaccgtaaaccgggtccttcgttacggacgtaaccgtacgttttaacgtttttcctccgttcgtacctactccgttaccgttggttaccttaacgtcgttaccgtacggtaccggtaccgggtccgtactaaacgtttcgttaccttcgttacgtaacctaaactacgttactccgtcccttacccgttacccccttaacttaccgtttccgtacggacggtaacctaaggtacgaactaactactaacgttccaacggtcgtcgtccgtaccgctacccgttacg

SEQ ID NO: 273323 - DNA, 869 bp, Homo sapiens
  misc_feature: GYAE6OF02I1RVX.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccacgccctcctgtctgcaagtggtgggagacagacgtctacccgtttttcggccgggtcgtacggtccggaccctagttcggaccgtacgttggtttcggtccttgggtacgtcggcggttaggacggtaccggacgggaccgtaacccgtaccctacctaacctttccgtaggtaacttaacgttacccgtttacgtacgttaccggtcgttgttcggtaccgtaccggggtttccggggtacccccttaccgttccggggttacgtaacgggttcggtaacccggtaaccgggtcttaccggtaacggtaacggtaaccgttaacggtttacgttttttcctaccgtttaccgttacctaacgttcccgtaacggttcggttacctaaccgttacgttaccgtaaccgggaacccgggtacccgggtacgttaaaccgtagtttccgtttaaccttccgttaggttaaccctaaacgttacccgttattcccgtaccccgtttacccccttaaccccccgttaagtttaacccggtttacccggggtaaccggtaaaccggggttaacccttaacggggttaaccgttaaaccctaacggttaacccgtaaacggtttaacccaacgggtttttccggaacgggttaccttacccggtaacccttaacccgttaccggtttacctttacccgg

SEQ ID NO: 273324 - DNA, 501 bp, Homo sapiens
  misc_feature: GYAE6OF02HTJBN.43.33.C11.1.454.CMB.1.raw
  modified_base (365)..(365): a, c, t, g, unknown or other
  misc_feature (365)..(365): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgcttgttgcacggttggggtcccactcggttcagtggcaacggctctgagacagtattttcnctcgtcatcacttggtctacgagtctgacgacggcgcaatgttacttctgtcaactactatcgcctcctccccctatactttcgtcgagggtacctaagtcactatacaatccatgtgctgcaccagtctgtctac

SEQ ID NO: 273325 - DNA, 761 bp, Homo sapiens
  misc_feature: GYAE6OF02GQWFN.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctccagcagacttccagatgtgacatccagatcgaccagtcgccacgcctccctgtctgctaagtggtgggacgacgagacgttacctacccgtttttcggccgggtacgacgttccggccctagttcggacgtacgttggttcggtccgtggtagtccgtcgtgacggaccgacgggccaaccgtcctactaaccgttcgtacgtattacttaccgttctaacgtcgtcgttgttcgtacgtaccggtttcgggtacccctaccgttcggttcgtacggttcgggaccgtaacggtcctacgtacgacggtaacgtagtttactttttccgtacttccgttactacgttaccgtacgttacggttacctacgttacgttacgtacggtaccggtacgggtaccgacgtaaacgtttcgttacctttacggttacgtaaccgtaaccgttaacctaccgttacccgttccccttacccccgttaaccccttaaaccgttaacgttttaccgggaccggttaaccgggtaaccgtttaaacggttacgaaaccgttacgtaacccgttaaacgttacggtaaccgtttcgggttaccggtaccgttaccggtacctacccggttaacc

SEQ ID NO: 273326 - DNA, 713 bp, Homo sapiens
  misc_feature: GYAE6OF02HK2TD.43.33.C11.1.454.CMB.1.raw
  modified_base (334)..(334): a, c, t, g, unknown or other
  misc_feature (334)..(334): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgactatccagatgacccagtcgccagcctccctgtcctgacgaagtgtgggagacagagtctaccttttggaccggcgaggtcgcctattcgacgacgtgtttggcctggtatcgtcgtgacgaccgagggacctaacccgtccctactaaacccttcgtaggtaattaacttacccggttnaactccgtctgttcgaccgtacggtttcgggtaccctaccgttcggttctaaggtcggaccgaacggtcctacgtagacggtactaggttactttttcgtcttcgtactatctacttcggtactacgtacgtcctacggaacggtacggcgtaaccgtaaattccgttaaccttcgtaagtaccctaaacttaccgttaacgttcccggtaccccttacccccgtttaccccccgttaagtttaaaccgtttccgggtaaccgtaaacggggttaaccctaagttaccgtaaaccgttaacttaaccggtaacgttaaccggaaccgtttgggtaccgtaccggtcgtaaccccgtaaccttaacgttcgttaacccgg

SEQ ID NO: 273327 - DNA, 675 bp, Homo sapiens
  misc_feature: GYAE6OF02HFMVX.43.33.C11.1.454.CMB.1.raw
tcagtgtgagtagtcacgaccggtgctcgatttagagtgagctcgttggggtttgggggcagaagtctctctcagtcaggacacagcatggacatgagggtccctgctcagctcctgggactcctgctgctctggctcccagattccagatgtgacatccagatgacccagtcgccagccctcctgtctgcaaggtgtgggagacgagagtcctaccctttttcggccgggtcgacggtccggccctagttcgacgtacttggtttggccgttggtactcggcgtgacgaccgagggccaacctcccgtactaaccttctgtacttactaccgttcaatcgactgttcgcgtaccggttcgggtccctccgttccggtcgtaggtcgccgtaaacggtccttacgtcggtactacgtacgttatttttcctcgttcggttctaacgttctacgtttcgtaccgttaactcgtcgttacggaacccggtcggtaccgacgtaaagttcgttacgttcgttacgtacctaaaccgtaccttacgttaccgaccccttaccccttacccccttaacgttaaccgtttccggtaaccgtacgggttaaccgacgttacgtaacgtaactacgtaacgtaacgtacgtgtacggacgtacgtaccacctagttcttaccg

SEQ ID NO: 273328 - DNA, 701 bp, Homo sapiens
  misc_feature: GYAE6OF02GUWGU.43.33.C11.1.454.CMB.1.raw
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctccagcagattccagatgtgacatccagatacgacccagtccgaccacgtcctccctagtctacgactaagtggtacgggagacaggacgttcttacccttttcggccgggtcgaacgtccggaccctattacggacgtacgttggtttacggccgttaggtaattcggngttacggacgacccgagggtaccaaccgttccactaacttcgagtattaactaccgttcagtcgacttgttacgacgtacggttcggaccctaaccgttcggttacgaggtcgacgtaacggcttacngagtactagtttacttttacgcctagtctaacgtctaacgttcggtactaacgtgtacgttacgaccggtaaccggtcgaacgttaactacggtttaacctttaccgggtattaacccaaacccgtactttaactcccggttaacccccttaccgttaacccccttaagttacgggttaactaccggtacgggaacccttaggtaacgtaaccttaacgctaaacgtccgaaacgttggtaaccgtaccgtacttaccgaaccttacg

SEQ ID NO: 273329 - DNA, 777 bp, Homo sapiens
  misc_feature: GYAE6OF02I6YOB.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagccctccctgtctgcaacgtggtagggagacgagacgttccttacccttttttcggcccggggtcgtacggtccggccctagttcggacgtactggtttcggccgttggtactcgcgtggacgacccgagggacctaacccgtccctacgtaacctttcgtacgtacttacgttacccggttccagtccgtacttgttcgccgtacgggttaccggggtcccctaaccgttccggttacgtaggtcggaccgtaaccggtctacgtacggtaacgtaccgtaaggttttactttttaccgttacccgttaccgtttactaaccgtttcgtaaccgtttcggtttaccgttaccgtaacggttccttacgggaccgggtaccgggtccgtaacgtaacgttacgtttacccgttcgttaccggtaaccctaaaccgttaaccttacgttcccgtacccctttaccccgttaccccccgttaaagttacccgttttaccgggaccggtaaccggggttaaccttagttacgaacttacgtaacgtaacgttacgacggttcgtacggtacctcggacctaccgtctttacgttcgttaccttaccg

SEQ ID NO: 273330 - DNA, 731 bp, Homo sapiens
  misc_feature: GYAE6OF02F5RZH.43.33.C11.1.454.CMB.1.raw
tcagtgtgagtagtcacgaccggtgctcgatttagagtgagctcgttgggtttgggggcgagaagtctctctcagtcaggacacagcatggacatgagggtccctgctcagctcctggactcctgctgctctgctccagattccagatgtgacatccagatcgacccagtccgccagccctcctgtctgcagtgtgggagacagacgtcttacccgtttttcggccgggtacgtacgggtccggtcccctattcggaccggacgtttacggtttcgggtcccgttgggttaacgtccggtacgttggaacgacccggtaaggggaccctaaccccgttacccttaccgtaaaccgtttcctacggtaacttaccgtttaaaccccggtttcctaacgttccgtctttggtttaccggcttaccgggtttaccggggtcccctaacccggtttcgggttccgtaaggttcgggacctaaccggtctcgtaggtaacgaccgttaagtttctttttaccgtcctacgttctactacctacgttggtaccttacgacgttctacggacgtccggtacgtactaacgttcgttaccgttcgttacgtacgtaacctactacgtcctcccgtccctaccccttaacttacgttccggtaccgtaagggtacctacgtacgtaactctaacgtaacctacgtaactcggtacgtacgtcgtaccactcgtaccttcg

SEQ ID NO: 273331 - DNA, 840 bp, Homo sapiens
  misc_feature: GYAE6OF02FO7U5.43.33.C11.1.454.CMB.1.raw
tcagtgtgagtagtcacgaccggtgctcgatttagagtgagctcgtttgggtttgggggaagtctctctcagtcaggacacagcatggacatgagggtccctgctcagctcctgggactcctgctgctctggctcccagattccagatgtgacatccagatgacccagtcgccagcctcctgtctgcaagtggtgggagacagtacgtccttacccgtttttcggccgggtcgacggtccggaccctacgttaggaccgtacgtttggttttcggccgtttaggttacgttccggcgttacggaacggacccgaacggggtacctaacccccgtccttacccgtaaacccgtttccgtacggtaacttaccgttaccccggtttactacgttccggtcgttacggtttcggaccgtttaaccgggtttcccgggggtacccccttacccggtttccggttccggtacgggttccggtacccgtaaccgggtcgtacgttacgggaacgtaccgtaagttttacctttttcctccgttccgttacgtacttccgtaacgttcggttacctaacgttacgtcgtaccggtacgggaccggtaccgactaagtttaccgtaccgtttcgttacggtaacctaaccttaaccgtacgttacccgttaccccttcccccgtttaacccccccttaagttaacccgggttttaccgggaccggtaaaccggggttaaccgttacgttaacgaccgttacgttaacctaaaccggttaccgtaaccggttcggttaccggtacgaccgtacccgtacccgttaatcccggtttcgtaccctttcccg

SEQ ID NO: 273332 - DNA, 838 bp, Homo sapiens
  misc_feature: GYAE6OF02G1TN9.43.33.C11.1.454.CMB.1.raw
  modified_base (670)..(670): a, c, t, g, unknown or other
  misc_feature (670)..(670): n is a, c, g, or t
tcagtgtgagtagtcacgaccggtgctcgatttagagtgagctcgttgggtttgggggcgagaagtctctctcagtcaggacacagcatggacatgagggtccctgctcagctcctgggactcctggctgctctggctcccagacttccagatgtgacatccagatcgaccagtcgccacgcccttccctgtctgcaagtgtgggagacagagttctacccgtttttcggccgggtacgtacggtccggacccgtagttcggaaccgtacgttcggttttcggaccgttcgggttaacgttccggtacggttggaacggtaaccggacgggggtaacctaaccccggtttacccttaccgttaaaccgtttcgttaccggttaactttaaaccgttaaccccggtttccaaacggttaccggtcctttacgggtttccggtaccgttaaccggggtttccgggggttacccccgtaacccgttttcccggggttaccgttaacgggtcgggtaaccgtaaccggtacccgttacggtacggaacggttaacaaacggttttaacgttttttccgtaccgttcgttaccgtaacttaccgtacggtttcggtaaccttacgtacgttccgtacggtaaccggacggtaccgtaactaacgtagttttaccncgttaagtcctaaataaccgttactccgttccctaccccttaccccttaacgttaaccgtttccgggttaacgaccgggtaaccgttaacggttaactaccgtaacttaacaaccgtaacctaacggttgtaccgttacgtccgtacctaaccgtcgtaaccgtttcg

SEQ ID NO: 273333 - DNA, 573 bp, Homo sapiens
  misc_feature: GYAE6OF02J2F36.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtggagacagacgtctacctttttgccgggcgacgtcggcctagtgaccgtactgttcggccgtggtatcgcgtgagaccgaggccaaccgtcctctaactctgatactccgttcactcgcttgtgcgtacggttcggtcccaccgttcggtactagtcggctacggtctgtcgagtactagttacttttcctctcgtctatcgtctggtactacgtagtacgcgacgacggctatagttcgtacttctacgtcaactctactcgtccccttctacccccttaatacgtttccggacgtaccggtaactagttacgactactacgtaacgtctaacgtcgttcgccgtcgtaccaccgttatcgttacgttaccttaacccg

SEQ ID NO: 273334 - DNA, 902 bp, Homo sapiens
  misc_feature: GYAE6OF02GAR5I.43.33.C11.1.454.CMB.1.raw
tcagtgtgagtagtcacgaccggtgctcgatttagagtgagctcgttgggtttgggggtcgagaagtctctctcagtcaggacacagcatggacatgagggtccctcgctcagctcctgggactcctgctgctctgcctcccagcagattccagatgtgacatccagatacgacccaacgtccgcccacgccctccctcgtctcgcaaggtggtcgggagacagtacgtccttacccgtttttcggcccgggtacggtacggttccggcccgtaagttccgaaccggtacgttcggttcggtccgttaggtacgttccggtcgtaggaccggaccggacgggtacccgtaaacccgtccctacctaaccttactacggtactttaaccgtacccgtttactaacgtccgtacgttcggtttacgccggttaccggtttaccgggttaccccctaccggtttaccggttacctacggggttacggacccgtaacgggtcccttacgacggtaacggtaccgtacgtttaacgtttttccgttaccgttaccgttacgtaccgttcgttaaccccgttacgggtaccgtttaaaccgtacgttaccggtaccggttaaccgggtaccgggtaccctacgtttaaacggttccttttaaaccgtttccggttaccgtttaaacccggaacctttaaccgggttaccttaaccccgttccccgttttacccccgttaaccccccctttaaaccgttaaacccggttttaacccgggttaccgggtaacccggggttaaacccttaaccgggttaaacctaaacccggtacttttaaccggaaaccgtttaaccggtacccggtttaggacccggtttaccggtaccgtaccgttaaccccgttacg

SEQ ID NO: 273335 - DNA, 721 bp, Homo sapiens
  misc_feature: GYAE6OF02HT4KV.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctccagattccagatgtgacatccagatcgaccagtcgccagccctcctgtctgcaagtgtgggagacagagttctacccgtttttggccgggtcgacggtccggccctagttcggacgtacgttggtttcggccttggtacgtcgtcgtggacgaccgagggaccaaccctcctaccaacgtttcgtagtaacttacgtaccgtttacaacgttccgtctttacgttcgaccgttaccgggtttccgggtacccctaccggttcggttaccgacgggtcggaccgaaacggtctcgtaggtaacgtacgttaacggtttacttttttccgtccgttacgttactactcgtaccgttggtaccttacgtacgttcgacgtaccggacggtccgaactaacgttacgttaccttcgttacgttaaccaaacgtaccgttacgtcccgtcccttaccccgtacccccgttaacgtttaccggtttacccggtaacggtaacgggtaaccttaacgttacgaaaccgttcgttaacctaacgttacgtaaccggttggtacgacttccggactaccgttattccgttacg

SEQ ID NO: 273336 - DNA, 749 bp, Homo sapiens
  misc_feature: GYAE6OF02HQK2M.43.33.C11.1.454.CMB.1.raw
  modified_base (338)..(338): a, c, t, g, unknown or other
  misc_feature (338)..(338): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacctttttcgccgggtcgacggtcggccctagttgaccgtacgttggtttcggccttggttactcgtcggttgacggaccgacgggccaaccctcccgtactaacttctagtacttacttacccgttnaacgtccgtcttgttcgccgtacggttcggggtccctaccgttcggttctaggtcggaccgtaacggtcgtacgttgaacgtacgtaagttacttttttctaccgttcgtactacgtcgtaccgttggtaccttaacgtacgttaccgttacgaccggtaccggtaccgaacttaacgttcgtttaaccgtttactcggttaacctaaaccgttaccgttaacgttcccgttaccccttacccccgttacccccccgtttaaacgttaaaccgttttcccgggttaaccggaaccgggggttaacccttaacggttaacggaaacccgttactaaccgttaaacgtaccggttaaacccgttgggttacggtacccgttcggtaacccgtaccttacgtccgttttacccg

SEQ ID NO: 273337 - DNA, 717 bp, Homo sapiens
  misc_feature: GYAE6OF02GDMU2.43.33.C11.1.454.CMB.1.raw
  modified_base (705)..(705): a, c, t, g, unknown or other
  misc_feature (705)..(705): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatcgacccagtcgccacgcctccctgtctgactaaggtggtagggacgacaggacgttccttacccgtttttcggccgggtcgtacggtccggaccctagttcggtacgtacgttggtttcggtccgttaggtacgtcggtcggtaggacggaaccgacgggacctaacccgttccctactaaccttctaggtaacttacgttaccgttactacgtcgtcgttcgttcgtaccgtacgggtttaccgggtccctaccgttcggttcgacggtcggacgtaacggtcgtcgtagacgtaactacgtttacttttcaccttcgtactacttccgtacgttacgtacctaacgtacggttcctacggaaccggaccgtcgtaacttaaccgttcgttaaccttcggtaccttaacctaaccgtactttaccgtccgtacccctttacccctacccccttaaagttacccggtttacccgggaccggtaaccgggaccttaacggtaacgaacttacgtactacgtacgtacgtcgtccggtacncgtccacttacg

SEQ ID NO: 273338 - DNA, 709 bp, Homo sapiens
  misc_feature: GYAE6OF02JYHL3.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagacttccagatgtgacatccagatcgacccagtccgccacgtccctccctgtctcgtacaaggtggtgggacgacagtacgttaccttacccgtttttcggccggggtacgtacggttccggcccgtagttacggtaccgtacgtttcgggtttccggtccgttgggttacgtccggtacggtacgtacggtaccggacgggacctaaccccgttccttaccgaaaccttcgttacgtaacttaacgttacccgttactactcgtcgttacggttacgtccggtaccggttccgggtccctacggttcgttcgacggtcggacgaccgtctgtcgacgtactagttactttctcgtactcgatcgtactcgtactcgtacgtcgtacgacggtacgccgtaatagtacgttacgttcctactaccgtaactaccttactaccgtacccttaccctaccccgttacgttacgtccgtaacggtaccgaacgttacgtaacgtactacgtaacctacgtaaccgtacgttcggtacgtacgtaccgtaccgtaccttactaccgtttccg

SEQ ID NO: 273339 - DNA, 774 bp, Homo sapiens
  misc_feature: GYAE6OF02FOI6K.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccacgcctcctgtctgcaagtgtgggagacagagtctacctttttgccgggcgagtcggccagttcgacgactgtttggccttggtatcgtcgtgagaccagggaccaacccgtcctaccaaactttcgtacgtaacttaacgtacccgtttacaacgtccgtcgttacggtttcgaccggttaaccggttccggggttcccctaacccgtttccggggttactacggtcgggtaccgtaaaccggggtcccttacgtacggaacggtaaccgtacggttaacttttttccgtccttaccgggttactaacgtccttaacgttacgggtttaccttaacgtacgttcccgttacggtaaccggacccgggtacgtaacgtaacgtttaaccggttacctttcgtaccgttacctaaacgtaccttacgtccggtacccttaccctacccccccgttaagttaaccgttttaccggtacggaaccggggttaaccgtaacggttaacgtaaaccgtaaccttaaccgtaaaccgtaacccggtaaacctttcgggtacggtccgttaaccggtaacctacccgttacttccgtttaacccgg

SEQ ID NO: 273340 - DNA, 920 bp, Homo sapiens
  misc_feature: GYAE6OF02J08VJ.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgcgtctggctcccagattccagatgtcgacatccagagtcgacccagtcgccacgcctcctcgtctcgccgaaggtcggtagggagacgagtacggttcctacccgttttttcggccggggtacggtacggtccgggtaccctaacgtttacgggaaccggttaccgtcggttttcgggtacccgttgggttaacgttcgggtcggtacggtaacgggaaccccggtaacggggtaccctaaaccccgttcccttaccgtaaacccgtttccgtaacggtacgttaaccgttaacccggtttcctaaacgttccggtaccggtttacggtttcggtacccggttaaccggggtttcccgggggttaacccccgtacccggttttccggggtttacccgtacgggttaccggttaccgaaaccggttccgtaaccgttcggaacgtaccgtaagttacgtttttcctacgtcgttactaacgttccaccggtttacgtccgttaaccgtagttaccgtaggtaacccgggaacggtcctaaaccgtaagtttccggttaacccgttacggttacgtaacccgtaaaccgtaacgttacccgttaaccggttccccttaccccgtttaacccccgttaacggtttaccgttttacccgggggtaaccgtaacgggggtaaaccccttaacgggtttaccaaccgtaccgttaactaaaccccggtagtaaccgggtgttacccggtaacttcgacccgttaaaccgtttcgaacccgttttggtaccccttttaaccg

SEQ ID NO: 273341 - DNA, 637 bp, Homo sapiens
  misc_feature: GYAE6OF02GVQ4U.43.33.C11.1.454.CMB.1.raw
  modified_base (627)..(627): a, c, t, g, unknown or other
  misc_feature (627)..(627): n is a, c, g, or t
tcagtgtgagtagtcacgaccggtgctcgatttagagtgagctcgttgggtttggggggaagtctctctcagtcaggacacagcatggacatgagggtccctgctcagctcctggggctcctgctgctctggcctcccagattccagatgtgacatccagatgacccagtccgccacgccctccctgtctgctaagtggtgggagacagacgtccttacccgtttttggccggggcgacggtccggccctagttcgacgtacgttgtttcggctggtatcgcgtgacgaccgaggccacctcctacaacttctgactactaccgttcatcgcttcgttgccgtacggttccggggtaccctaccgttcggtctaggtcggcgtaacggcctcgtgagaactagttcttttctcttcgtctactctacgtggtactacgtacgtctggacggacggccgagtacttgtaactttctacgtactaactacttacgtccgtccctaccccttaccccctaacgttaccgtttaccggtacggtacggggaaacctacggttacaacgtacgtaacgtaacttaacggaaccttgggtaccggtagtcgaccctaccgtacttaccggttntcctttaccg

SEQ ID NO: 273342 - DNA, 1018 bp, Homo sapiens
  misc_feature: GYAE6OF02IY7OU.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcaggctcctgggactcctgctgcgtctggcctcccagacgagtacttaccgagtagtagtacggacacttaccgaaggtaacgtacgaaccccgtacgtaccggacccgtacggtccccttccccgttcggtcctacgtaacgtaacggttcgggtaggggaacgaacgtacggtacggtttacccgtttaacccggtttttttacgggccccggggtacggtaccggttccggaccccgttaacggtttccggtaaccgtaacggtttcggtttttccgggaacctttcgggtaacgttaccgggtacggttagggtaaaccggtaacccgggtaaccggggacccctaaaccccgttacccgttaaccggttaaaccctttccgttaacggtttaaccgttaaacccgttttaacccggggtttaccctaaacggtttccggtaccgtttaaccggttcgggtaaccggttaacccgggggttttccccgggtaccccgttacccgggtttttacccgggttaccggtacgggttacccgggtaacggtaccggggtactttaacggtacggtacggtaaaccttacggttttaccttttaccgttacccgtttacgttacccgtaacgttacggtaccgttagttacccggttactaaccggttacgtaccgggtaccgtaacccgggtacgtaccttaacggtttaccgttaacccgtttcgttaccgtaacttaaaccgttacgttacccgttccgtaacccccttccccggttaaccccttacccggttttaaacggtaccgttaccggtaaccggggttaaccgttaaggttaccgaacgtaactaacccgttaggttaaactcggttacgtaccgggaccttaacgaccgttacccttaaccg

SEQ ID NO: 273343 - DNA, 641 bp, Homo sapiens
  misc_feature: GYAE6OF02IA7Y8.43.33.C11.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (335)..(335): a, c, t, g, unknown or other
  misc_feature (335)..(335): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagccctccctgtcngcaaggtgtggganacgagagtccttaccgtttttggccgggtcgtacggtccggccctagttacggacgaccttggtttcggcctggttatccgtgtgacgaccgagggccaccgtcctcgaactttcgagtattacttaccgtntactcgtcttgttcgctacgggttcgggtccctaccgttcgtcacggtcgtacaacggtctcgtcgagtactaggttactttttcgcttacgtctctactactggtacgtatacgtctacggtacggacgtccggtactacgtaggttcccttacggtctaaccgtaactaccttaattcccgcccctttaccctaccccttaacgttaccgttacggtaaccgacgggttaaccgagttaccgacgttaactactaaccgtaccaacgtttcggacgtcgtacgtcctaccgtattccttaaccg

SEQ ID NO: 273344 - DNA, 586 bp, Homo sapiens
  misc_feature: GYAE6OF02F1DLS.43.33.C11.1.454.CMB.1.raw
  modified_base (200)..(200): a, c, t, g, unknown or other
  misc_feature (200)..(200): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagatccagatgtgacatccagatgacccagtcgccagcctccctgtctgcaagtgtggganacagagtctacctttttgccgggcgacggtcggccattgacgactgtttggcctggtatcgcgtgacgacacgggcaacctccgtacaactttctagattactaccgtttcaactcgtcttgttcgctacggttcggggtcccacgtcggttcaggtcggacaacggctctgacgactagtatttttcaccttcgtctatctacgttcggtctactagttctaggaccggacggtcgactaagttcgtacttcttcgtacaactactagtcgcccttccctaccccctacgttaacgttccggtaccggacgggaccgtaacgttcgaacgtaacactaacgtactaacgtggtacgtacgtcggacctaccgtacgtcttaccgg

SEQ ID NO: 273345 - DNA, 684 bp, Homo sapiens
  misc_feature: GYAE6OF02ILMM6.43.33.C11.1.454.CMB.1.raw
  modified_base (201)..(201): a, c, t, g, unknown or other
  misc_feature (201)..(201): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggcctcccagattccagatgtgacatccagatcgacccagtcgccagcctccctgtctgcaagtggtggganacagagtctacccgtttttggccgggcggacggtccggcccagttcgacgtacgttggttttggccgttggttactcgtcggtgacggaccgacggggcaaccctcctctaacttctgattactaccgttcatcgctgttcgctacggttcgggtccctccgtcggttcgaggtcggaccgacggtctcgtgacgactagttatttttccgtccttcgttactacttctaccgtttcgtcctacgtacgttcgacgtaccggacggtccgtactaaacgttcgtttaaccttcgtacgtacctaaacctacgttacgtccgtacccgttacccccttaccccgttaaacgttaccgttttcccgtaaccggaacggggttaaccctaagttacggaacgtacttaacgtaacgttaccgtaacgttcggttacggtacgttccggaacctccgttaacgttccgtttaccttactttaccccg

SEQ ID NO: 273346 - DNA, 709 bp, Homo sapiens
  misc_feature: GYAE6OF02F9TML.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagtatgtgacatccagatcgacccagtcgccagcctccctgtctgcaagtggtgggagacgagacgtctaccccgtttttggcccgggcgtacggtccggccctagttcgaccgtaccgttgtttcggccttggtacgtcggtcgttaggacgacccgagggaccaacccttccctcctaaccttctagtactacttaccgttcagtcgtcttggttcgtccgtacggttccggggtcccctaccgttccggttctagggtcggacgaaccggtcgtcgttacggagtacgtagtttacttttccgtccgttacgtctacttccgtacgttcgttacctacgtacgttcgtacgtaccggtaccggtccgtactaagttacgttacttcgtcgtacctaactaccttactccgtacccttcccttacccccgttaacgttaccgtttaccggtaccgaaccgggtacctaaacggttacgaacttacgtacgtaacgttaccggtaacgttcgttacggtaccttacggtaccctaacctacgtaccgtttacggtcctttacccg

SEQ ID NO: 273347 - DNA, 667 bp, Homo sapiens
  misc_feature: GYAE6OF02JG02U.43.33.C11.1.454.CMB.1.raw
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
  modified_base (358)..(358): a, c, t, g, unknown or other
  misc_feature (358)..(358): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctcccagattcagatgtgacatccagatgacccagtcgccagcctcctgtctgcaagtgtgggagacagacgtcaccgtttttgccggcgagtcggccattgcactgttgcctgtatcgcgtngacaggcaactctcactctgataactcgtcatcgtctgttncgtacgttcgggtccctacgttcggtcagtgaccgagtctcgtgacgatagtacttttcncttcgtcacttctactcggtactacgtcgttactacggtaccggaccggtacgaccgttaaagttccggttaccttacttaccggtacctaaaccgtaacctttacgtaccgtacccctttacccgttacccccccgtttaattaaacccggttttccgggtaaacccgggttaaccggggttaaccccgttaaacgtttaaccgggtaaacccttaaacggttacctaaaccgtttacgggtaaaccgttcggggttccggtaaccgttacccgggtaacgttaaccccctaggtttaccgtttaccg

SEQ ID NO: 273348 - DNA, 633 bp, Homo sapiens
  misc_feature: GYAE6OF02HTEY3.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggcctccagtattccagatgtgacatccagatgacccagtcgccacgccctccctgtctgactaagtggtgggagacgagtacgttccttacccgtttttcggccgggacgacggtccggccctagttacgacgtacgttggtttcggtcgttggtactcgcgtgacgaccgaggccaacctcctacctacttctgtatactaccgttcacgtcgtcttgtcgtcgtaccgggttccgggtaccctacccgttcggttacgacggtcggaccgtaacggtctcgtgacgtactacgtttctttttactccgttacgtctacttacgtcgtttgtactacgtagtcgtacggacggtacgctaacgttacttcgttacttgtcacctaactactcgttccctacccttcccttaccccttagttaacgttccgaacggtacggtaacctagtctaacgctaagacgtaacgtacgtggtctcgaccgtactctatcgttccg

SEQ ID NO: 273349 - DNA, 946 bp, Homo sapiens
  misc_feature: GYAE6OF02JZ36A.43.33.C11.1.454.CMB.1.raw
  modified_base (917)..(917): a, c, t, g, unknown or other
  misc_feature (917)..(917): n is a, c, g, or t
  modified_base (938)..(938): a, c, t, g, unknown or other
  misc_feature (938)..(938): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctcgtggcctcccacgattccaggatcgtgacactcccgagacgttcgaaccctaaggtcccggcccacggtccccttcccccgttcgttcctcggtaccgtaaggttcgggtagggggaacgaaccgaggtaaccggtttccctttaaccccggttttttttcgggccccggggggtacgtaccggttcccggggtacccctaaggtttccggtaaccggttacgttcgggttttcgggtccccgttaggggttaaccgtttccgggcgggtttacggtaaccgggtaaccccgggaacggggtaaccccgttaaacccccgttaccccgttaacccttaaccccggttttacgttacccggttaacgttaacgtttaaccccggttttacccgaaacgtttcccggttaccgtttcgggtttcccggaccgggtttaacccggggtttcccggggggtttaacccccttaccccggtttccggggtttccttaacggggggtccgggttaacccggtaaccgggttcccgttaccggtacggtaaccgtaaacgttaacggttttactttttaccgtttccgttacgtaaccgttacgttacccgtacgtcggttaacccgtacggtaacgtccgtacggtacccgggcggtaccgagttacgtcgtttacttccgtgtaccctaacgtaccgtctaccgtcccttaccccgtccccttaacgttacggttaccgaacgttaccggaccttaacggtgaactacacgtacgtaccgtaagtcggtacgtnacgctaaccttgtacttcgtnttaacccg

SEQ ID NO: 273350 - DNA, 650 bp, Homo sapiens
  misc_feature: GYAE6OF02FJC34.43.33.C11.1.454.CMB.1.raw
  modified_base (523)..(523): a, c, t, g, unknown or other
  misc_feature (523)..(523): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagcagattccagatgtgacatccagatcgacccacgtcgccacgcctccctgtctcgcacgtggtgggagacacgacgtctaccgtttttcgccgggtcgtacgtccggcctacttcggacgtacgttggtttcggccttggtactcggtcgttcgacgaccgacgggaccaacccttcctactaacttcgtagtactacgttaccgtcacgtcgcgttgtcgcgtaccggtcgggttacccctaccgttcggttactacggtcggtaccgtaccggtcgtcgttagacgtacgtagtttacgttttacctccgttacgtactacgtactacgttcggtacctaacgtcgtactcggaaccgcggcatacgtacttacttacncgtaccaacttctacgtccgtaccttacccgtacccctaattacgttccggtacgtaacggtaacctaggttaacaactaccttaacacgttacgtacgttacggtcgaccgtcacctaacttaccg

SEQ ID NO: 273351 - DNA, 767 bp, Homo sapiens
  misc_feature: GYAE6OF02JH0HV.43.33.C11.1.454.CMB.1.raw
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatcgacccagtcgccagccctccctgtctgcaagtggtagggacgacgagacgttcccttacccgtttttcgggcccggggtcggacggttcccggacccctagttcggtaaccgtaccgttggttttcgggtcccgttggtaacgtccggtacggttaggaccggaacccggaacggggaccctaaccccttcccgtacctaaccgtttactaggtaacttaacgttacccgttactacgtcggtactggttcgcgtacggttccggggtcccctaccgttcggttacacggtcggtacgaccggtctcgtacggacgtaactacgtttacttttcctccgttcgtactactccgtagttcgtacctaacggtcgttccgtacggtacccggacggtcctaacgttagttaccgtttaccttcgttaagtaccctaaacgtcttacgtcccgtacccttacccccttaccccctaagtttaaccgtttcccgggaacggtaaacgggaaccttaagttaaccgaccgtaattaacccgaacggttacctaaccggtggttaccgaccttaccgactacccgttagtccggtttccttaccttaacccg

SEQ ID NO: 273352 - DNA, 720 bp, Homo sapiens
  misc_feature: GYAE6OF02F2SRQ.43.33.C11.1.454.CMB.1.raw
  modified_base (208)..(208): a, c, t, g, unknown or other
  misc_feature (208)..(208): n is a, c, g, or t
  modified_base (412)..(412): a, c, t, g, unknown or other
  misc_feature (412)..(412): n is a, c, g, or t
tcagtgtgagtagtcacgaccggtgctcgatttagagtgagctcgttgggtttgggggcagaagtctctctcagtcaggacacagcatggacagtgagggtccctgctcagctcctggactcctgctgctctggctccagattccagatgtgacatccagtactcgacccgagtccgccgacgcctccctgtctgacaagtgtcgganacagacgtcctaccgttttgccggacgagtccggcctagttcgacgtacttcgttcggcttggtactcgcgtagacgtacgacggactaacctctacgtaacttcgtacgtaactacgtaccgttcaacgtcgtctttcgtcgtacgtaccggtttcgggaccctacggtacggttcgaaggttcggaacctacggtctacgtnaacgtacgtacgttaactttttcgacttgtactaacgttccgtaaccgttcggtaaccttacgtaacgttccgttaacggaccggacggtaccgttaacgttaataccggtttacttacgtacggttaaccaaaccgttcctaaggttcccgtaaccccgttcccctaacccggttaacttaaccggttttccggaaaccggttaacggacccgttttaaacggacgttaaacgcgttaaaccgttacggtaacgttaacggtcgaccggtttcaacccgtaccggacctttacggtacctttacccg

SEQ ID NO: 273353 - DNA, 179 bp, Homo sapiens
  misc_feature: GYAE6OF02JE4AD.43.33.C11.1.454.CMB.1.raw
  modified_base (154)..(179): a, c, t, g, unknown or other
  misc_feature (154)..(179): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctctggctccagcagattccagatgnnnnnnnnnnnnnnnnnnnnnnnnnn

SEQ ID NO: 273354 - DNA, 616 bp, Homo sapiens
  misc_feature: GYAE6OF02H6W9N.43.33.C11.1.454.CMB.1.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
  modified_base (506)..(506): a, c, t, g, unknown or other
  misc_feature (506)..(506): n is a, c, g, or t
  modified_base (611)..(611): a, c, t, g, unknown or other
  misc_feature (611)..(611): n is a, c, g, or t
tcagtgtgagtagtcacgaccggtgctcgatttagagtgagctcgttgggtttgggggcagaagtctctctcagtcaggacacagcatggacatgagggtccctgctcagctccgtgggctcctgctgctcgtggcctccagcagtattccagatgtgactatccagatcgaccctgcgccacgtcctcctgtctgcaagtggtggganagtagtacgtccgttaccctttttggcccgggtcggtacgtccgggaccctgttacggaccgtacgttggttcggccgtacggtcgttcgngtcgacggaaccgngggtcccacgtcctactaactctntacttacgtccttctactcgtgtatcgcgttcggtccggacctcgttcgtgacggtcgcaacggtctntacganactagtttcttcttcgactcctatcctaagtntcacgtgtagtccgaacggtccggtacgtanaactttntctttaacgctaacctaaaccttntaccgtccgttacccttccccaacccttatacgggttaccgtcgggtaaccgtacgttacgacttaacgctacttaacgtcgactttgggcctaaggtctacccnttacc

SEQ ID NO: 273355 - DNA, 709 bp, Homo sapiens
  misc_feature: GYAE6OF02FRBMC.43.33.C11.1.454.CMB.1.raw
  modified_base (419)..(419): a, c, t, g, unknown or other
  misc_feature (419)..(419): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccacgcctcctgtctgcaagtgtgggagacagtagtccgttaccctttttcggccgggtcgtacgtccgggaccctagttcggaccgtacgttggtttcggcccttggtacgtcggcgttgacgaccgagggacctaaccctcctactaacttcctagtacttacgttaccgttcaacttcgtcttgttcgtcgtacgggttccggggtacccaccggttcggtacgtaggtcggaccgacggtctcgngaacgtacgtagttactttttcgccgtttccgtactacttacccgtagttcggttacctacgtacgttccgtacggaccggtaccggtacgacttaagttcgttacctttcgtaactaacgtaaccttacgtacttccgtaccccttaccccgttacccccgttaagtttaccggttccgggtaccgtaacggttaaacctaacgggtttacctaacgtcttaaccgtaacgttaccgaacggttcgttagtccgtactacccacgttacttcgttacttccttaacccg

SEQ ID NO: 273356 - DNA, 782 bp, Homo sapiens
  misc_feature: GYAE6OF02GJXV8.43.33.C11.1.454.CMB.1.raw
tcagtgtgagtagtcacgaccggtgctcgatttagagtgagctcgttggggtttgggggcagaagtctctctcagtcaggacacagcatggacatgagggtccctgctcagctccgtggactcctgctgctctcggctcccagtacttccagatgtgacactccagatacgacccagtccgccacgccctccctgtctagacctaaggtggtagggacgacgacgtacgttcccgttacccgtttttcggaccggggtacggtacggtccggacctacgttcgacgtacgttcgtttacggtacgtaggttacgtcgtcggtacggaacgaccgacgggtacctaacccgtacccgtacctaacgttcgtagtaactaaccgttaccgttacgaacgttcgtcgttcgttccgtaccggttacgggttaccgggtaccccgtaccgttacgggttaccgtagggtaccggaccgtaacggtcttacgacgtaacgtaacgttacggtttaactttttccgtcgttaccgtacgttacttaccgtaaccggttgttaaccgtacgttacgttaccggttaacggaacccggtaccggacgttactacgtttacgtttacgttacgtactaacgtaaccttagttactacccgtcccttaccccttacccgttaaacgtttcgtacggaaccgggtaacggtaacgttacgttaaccgaactacgttaacgtaacgtacggtaacgttcggacggtaccgtataccctacgttactccgtttac

SEQ ID NO: 273357 - DNA, 661 bp, Homo sapiens
  misc_feature: GYAE6OF02FNJOT.43.33.C11.1.454.CMB.1.raw
  modified_base (167)..(167): a, c, t, g, unknown or other
  misc_feature (167)..(167): n is a, c, g, or t
  modified_base (186)..(186): a, c, t, g, unknown or other
  misc_feature (186)..(186): n is a, c, g, or t
  modified_base (302)..(302): a, c, t, g, unknown or other
  misc_feature (302)..(302): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagtattccagatgtgacatccagatgacccngtcgccagcctcctgtctncaagtgtggagaccagagcctacctttttggccggtcgacgtccggccctatgacgacttgttgccgtggtagtcgcgttgacggacctagggcctaacctcctactacttcgtanacttagtaccgttcactcgtctggtcgtccgtacggtacgggtccctacgttccggttcgagtcggacgaccggtctcgtaggacgtacgtacgttacttttctacgttacccgtcgtcgttacctaacggtcggtttactaccgtacgttaccgtacggtaccggaccggtccgactaacgttagtaccgtttaccgtgttaaccctaaccgttaactaccgttctacccgttacccttacccgttaactaccgttacggttcctaccggggtacctaacgttacgtactacgtaacgtaccgtaacgtacgtacggtaggtccttacgaccgtcgtactacgttcgttacttacccg

SEQ ID NO: 273358 - DNA, 768 bp, Homo sapiens
  misc_feature: GYAE6OF02FFQMJ.43.33.C11.1.454.CMB.1.raw
  modified_base (732)..(732): a, c, t, g, unknown or other
  misc_feature (732)..(732): n is a, c, g, or t
tcagtgtgagtagtcacgaccggtgctcgatttagagtgagctcgttgggtttggggcagaagtctctctcagtcaggacacagcatggacatgagggtccctagctcagctcctgggactcctgctgctctggcctcccagatccgagtatgtgacatccagatgacccagtccgccgagccctcccgtgtcgtcgacgaacgtggtacgggacgacagtacgttacgtaccctttttcggccgggtacggacgtcccggtccctattccggacgactcggtttcggaccgttggtaacttccggcgtacggtacgaaccgaggggacccaacccgttccgtacgtaaccttcgtacgattaacctaccggtttcaaagtccgtacttcggtacgtccgtaacggtttccgggtcccctacggttacggttcgaggttcggaccgtaacggtccgttcgaaggtacgtacgtacgttaacttttttccgacgttaccgtacgttaactaccgtaacgttacggttaccttaacgtacgttacgttacgaaccggaccgggtcgacgtacgttacgttaccttcgtacgtacctaaacgtaccttacgttccgtaccccgttaccctacccccgttaacgtacggtttaaccggtaccggtaacgggtacccgttaagttacgtaaccgtaactaaccgtaacgttacccggaacgttcgttaacccgggtnttaacccggactacccgttacttacccgtttaaccg

SEQ ID NO: 273359 - DNA, 762 bp, Homo sapiens
  misc_feature: GYAE6OF02IFQYI.43.33.C11.1.454.CMB.1.raw
tcagtgtgagtagtcacgaccggtgctcgatttagagtgagctcgttgggtttggggggaagtctctctcagtcaggacacagcatggacatggagggtccctgctcagctcctgggactcctgctgctctggcctcccagacttccagatgtgacatccagatacgacccagtccgccacgccctcctgtctgactaggtggtgggagacagacgttccttacccgtttttcggccgggtacgtacggtccggcccgtagttcggaccgtacttcggtttacggccgtggtactcggcgtagacggaccgacgggaccaaccctcctactaaccttcttagtaacttacgtaccgttctacgtcgtcttgttcggccgttaccgggttccggggtccctaccggttcggttaccgaggttacggaccgtaaccggtccttacgtaggtaacggtacttaacgtttcgttttttaccgtaccgttccgtttactacgttacctaacggtttacggttcctaacgttacgtccgttaacgggtaccggtaccggacgtaacctaacggttacgtttaacctttccgttacgtaacctaaacgtaccttacgtcctacccccgttacccccttacccccgttaacgttaccgtttaccgggaacgtaccggggtaacttaacgtacgaacgtacttacgaacttaccgtaacgttcggtacgtaccgtcgacccgtacctacgttccttaccgttacttacccg

SEQ ID NO: 273360 - DNA, 747 bp, Homo sapiens
  misc_feature: GYAE6OF02JHQCE.43.33.C11.1.454.CMB.1.raw
  modified_base (729)..(729): a, c, t, g, unknown or other
  misc_feature (729)..(729): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctgctcccagattccagatgtgactatccagatcgacccagtcgccagtccctccgtgtctgcgaagtggtgggagactaggacgtccttacccgttttggcccgggtcggacgtccggcctagttcggtacgtacgttcggttcggccctggtatcgcgtgaggaccgagggtacctaacccgtcctacctaacgttcgtagtacttacgttacccgttcgtaacgttcggtaccgttcgttacggtacccggtaccgggtttaccgggggtacccccctaaccggtttcccggggtttaacctacggggttacggggtacccgtaaacccggggtccgttaaccgttcggtaaaccggtaccgtaacggtttacgtttttcctaccggtaccgttactaccgtcgtaaccgtttcgggttaccttaccgtacggttacctaccgggtacggtaccggccgtaccgttaagttaccgttaccgttactacggttaccaaacctcgttacgtcctaccctcccgtacccctagttacgtcgacgacggtactagtaccatgtactacgtacgtaagtccgtagtccgtagtaccctacgttntccgttacgtgttacccg

SEQ ID NO: 273361 - DNA, 702 bp, Homo sapiens
  misc_feature: GYAE6OF02IP14O.43.33.C11.1.454.CMB.1.raw
  modified_base (563)..(563): a, c, t, g, unknown or other
  misc_feature (563)..(563): n is a, c, g, or t
  modified_base (571)..(571): a, c, t, g, unknown or other
  misc_feature (571)..(571): n is a, c, g, or t
  modified_base (590)..(590): a, c, t, g, unknown or other
  misc_feature (590)..(590): n is a, c, g, or t
tcagtgtgagtagtcacgaccggtgctcgatttagagtgagctcgttgggtttgggggcagaagtctctctcagtcaggacacagcatggacatgaggtccctgctcagctctgggactcctgctgctcgtggctccagcagtacttccagattgtagactactccagatcgacccagtccgccacgtccctcctcgtctcgactaacggtggtagggtacgacgacgtacgttaccgttaccccgttttttcggacccgggtacgtacggtcccggccgtacgttacggaaccgttacgttcggttttcggcccgttggtaacgtccggtcggtacgacgtacccgacgggaccctacccgtacctacgtaccttacgtcgtaacttacgttacccgttacacgttcgtccgttaggttcgaccgttaccgggttacgggacccctacggttaccggttcgacgggtttaccggacgtaccggtcctcgtacgtacgagtacgtttactttccgtctcgtacacgttcacgttcgtacgtacgtctcgtacgacggcgtacncgtacctnttacgtcacgtactaaccntacgtcctccctccttaaccccgtattaaccgttcggtacgtaccggtaccttaaggtacctacggttactacgtaaacgtccgtaaggtcgtacgcctacgacctagtccc

SEQ ID NO: 273362 - DNA, 875 bp, Homo sapiens
  misc_feature: GYAE6OF02HOPXC.43.33.C11.1.454.CMB.1.raw
  modified_base (163)..(163): a, c, t, g, unknown or other
  misc_feature (163)..(163): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgtctgctcgtcggcctacccagtacttaccgagtatggtacncaacttccgaacgtactaccggaaccctcgccggaccaccgtccccgtcccgtgttctcgaacgtaggttgggtacggaacgaacgtaggtacttacccgttttacccggtttttccgggccggggtaccggtaacggttcccggacccgttaagttcgaacgtttcggttggttttaccggtccgttcggtattccgggacgttcgaacggacccggtaacggccttaacccctaccctaccgtaacgtttcgactaacgttacgttacccgtctacgttccgtgtttcgtccggtacggttaccgggtttccccgggtaacccttccggttccggttcgacggtcgggtaaccctacggttccgtacgtaggtaaccgaacgtttacttttacccgtttttccgtccggtactttaacccgagtttaccctaccggggtttcgttaaccctttaggtaccggttaccgtacggaacccggtacgggtccgtaccgttaacgttacgtttacccgtacgttaccgtactaacccgtaacgtttcgccccggtttaccctaccccccgttcctaaaccggttccggtttaccggtaccgggtaaacggtaaccgtttaagtaccgtacgtaaccgtttagaaccgttaaccgcggttaacggtcgtccgttacgacccgttaacgttctttaccggttactttcttaacccg

SEQ ID NO: 273363 - DNA, 716 bp, Homo sapiens
  misc_feature: GYAE6OF02G2J3X.43.33.C11.1.454.CMB.1.raw
  modified_base (190)..(190): a, c, t, g, unknown or other
  misc_feature (190)..(190): n is a, c, g, or t
  modified_base (700)..(700): a, c, t, g, unknown or other
  misc_feature (700)..(700): n is a, c, g, or t
tcagtgtgagtagtcacgaccggtgctcgatttagagtgagctcgttggggtttggggggcagaagtctctctcagtcaggacacagcatggacatgagggtccctgctcagctccgtgggactcctgctgctctggcctccagattaccagatgtgacatccagatcgaccagtcgccacgccttcctntctgcaaggtggtagggtaagacgagacgtcctaccgtttttagccgggtacggtacggtccggacctaagttcgacgtacttggttcggtaccgttggttacgtcgtacggtacgtacgaaccggaacggacctaacccgtacctaaccgtaaccgtttacgtacggtaacgttaaccttacccggtttactacgttacgtaccgttacgttaccggtaacgttaccgggttaccgggtacccgtaccgttcggtacgtacggtacggaccgtaaacggtcgtacgtagaacgtaactacgtttacgtttttctacgttcgttactaacttacctaacgttcggtaacttaacgtaacgttccgtacggtaaccggtacggttacgtaacggtaacttacgttacgtacgtacggtaactacgtactacgtccctacctccccttaaccgtactacgttacgtaaccgagtacaggtaccaacgtacaactactagacgtaggctacgntaccgatacgtcgtac

SEQ ID NO: 273364 - DNA, 768 bp, Homo sapiens
  misc_feature: GYAE6OF02GS42F.43.33.C11.1.454.CMB.1.raw
  modified_base (214)..(214): a, c, t, g, unknown or other
  misc_feature (214)..(214): n is a, c, g, or t
tcagtgtgagtagtcacgaccggtgctcgatttagagtgagctcgttgggtttgggggcagaagtctctctcagtcaggacacagcatggacatgagggtccctgctcagctcctgggactcctgctgctcgtggcctacccagattccagatgtagacatccagatcgacccgtagtccgccacgccctccgtgtctgactagtggtaggganacgtagacgttaccgttacccgttttcggaccgggtacgtacggtcccggacctagttacggacgtcgttaggtttcggtaccgttaggtacgtccgtacggtagaacggaccggtaccgggtacctaacccgttcctaccgtaacttcgtagtaaccttaaccgttaaccgttacaccgttacgtcgttcggtacgtaccggtaccgggttcccgggttaccctacccggttccggttacgtacggtaccgtaaccgtaacgtccgtactacggtaacgtcgttagtttaccttttactacgttccgtactaacgttacacggtttacgtcgttaccgacgttaccggtacggaaccgggtaccgtacgtaccgtaattcgttaccgttaccgtagtaccgtaaacctacggttaccttaccgccctttaccctaacccttagtttaccgttaccggaacgggttaaccgtaccgttacggttactaaccgtaacgtaaccacgtaaccggtaaggtcgtacggtactccggtaacctcgttactacttaccg

SEQ ID NO: 273365 - DNA, 790 bp, Homo sapiens
  misc_feature: GYAE6OF02HC07T.43.33.C11.1.454.CMB.1.raw
  modified_base (153)..(153): a, c, t, g, unknown or other
  misc_feature (153)..(153): n is a, c, g, or t
tcagtgtgagtagtcacgaccggtgctcgatttagagtgagctcgttgggtttgggggaagtctctctcagtcaggacacagcatggacatgagggtccctgctcagctcctgggactcctgctgctctggctcccagtacttccaagatgtnactactccagatcgacctagtccaccacgtccctccctgtctacgacgtaacgtggtagggacgacgacgtacgttaccctttacccgtttttccggaccgggtccgtaccggtaccggtaccctacgttaccggtacgttaacgttggtttcggtccgttggtaccgtccggtacgtcggaaccggtaaccggacgggtaccctaacccgtacctaccgtaacctttacgtacgtaacgttaccttaccgttacgtacgttaccggtcgttacggttaccggtaccgttaccggggttcccggggttacccctaccgggtttacggttaccggtaacgggttacggacccgtaaccgggtccttaccggtagaacggttaacttaacggtttactttccggttacctaccgttacttactacgttcgtacttaccgtacgtcgtttacggacgtacggaccgtctaacgtacgtacgttcctacgtaccgtaactactactactcccgtcccttacccgtaccttacgtcggttaaccgtcggacgtacgtagtaccgaagtacgtaaccgtacgtacctaggtagtacccgtacgttacccgtacgtacccttacgtcgttaccgttacccgtcc

SEQ ID NO: 273366 - DNA, 728 bp, Homo sapiens
  misc_feature: GYAE6OF02HAW28.43.33.C11.1.454.CMB.1.raw
tcagtgtgagtagtcacgaccggtgctcgatttagagtgagctcgttgggtttgggggcagaagtctctctcagtcaggacacagcatggacatgagggtccctgctcagctcctgggactcctgctgctctggcctcccagattccagatgtgacatccagatgacccagtcgccagcctcctgtctgcgaaggtgtgggagacgagacgtctaccgtttttgccgggtcgacgtcggcctagttcgacgtacttgtttcggccgtggtactcggcgtagacgacgacgggacctaacctccgtaccaacttcgtagtaacttagttaccgttacacgttaccgtacgttcgttacggtccgtacgggtttccgggtacccctaccggtttccggttacgtaacggttcggaccgtaaccggtctcgtagacgtacgtagttacttttcctcgttacgtactacgtcctacgtgttacctaacgtcgttactaccggaaccggtaccggagttactaaggttccgttaacgttctaacgtacctaactacgttacttacccggtccctttaccccgtaccccgtttaaaccttcggttttacccgggaccgggtaaaccgggtaaccgttaacgggtttaacgaacccggtaacgttaacccgaagtttaacccgtacggttaagggtccggtaccgtacgacccggttactaacggttcgttaccg

SEQ ID NO: 273367 - DNA, 613 bp, Homo sapiens
  misc_feature: GYAE6OF02IAN2J.43.33.C11.1.454.CMB.1.raw
  modified_base (205)..(205): a, c, t, g, unknown or other
  misc_feature (205)..(205): n is a, c, g, or t
  modified_base (365)..(365): a, c, t, g, unknown or other
  misc_feature (365)..(365): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
tcagtgtgagtagtcacgaccggtgctcgatttagagtgagctcgttgggtttgggggcagaagtctctctcagtcaggacacagcatggacatgagggtccctgctcagctacctgggactcctgctgctctggctcccagattccgagatgtgacatccagatgacccagtcgcagcctcctgtctgcaagtgtggagcgagngtcaccttttgccggcgagtccggcctagttgacgcttacggttggtacctggtatcgcggttgacgtaccgagggacctaaccgtccctcgtaaacgttctaggactagtaccgttcgatcgcgttcgtagctacggttcgggtacctacgtccggttntacggtcggactaacggctctaganacgtagtacttttcncgtcgcacgttcacgtggtcctagtctcgtacgtcgacggcgtactaatcggttaactcgttagtaaccactaacgtacttcggtacccttaccgtaccccgttacttaaagtttccggtaccgaagggttaacctaggttcggaaactacgttacctaagtaacggaccttagggtacgacgtaccgtaccgactacttcgttaccg

SEQ ID NO: 273368 - DNA, 428 bp, Homo sapiens
  misc_feature: GYAE6OF01DN8RD.29.68.G02.1.454.CMB.1.raw
  modified_base (422)..(428): a, c, t, g, unknown or other
  misc_feature (422)..(428): n is a, c, g, or t
tcagatagagtactcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttcaccactgggccggggcaccctggtcagcgtctcctcagcctcaccaagggcccatcggtcttccccctggcaccctcctccaagagcacctctggggcacagcagccctgggctgcctggtcaaggactacttccacgtagcgtgctgagcgggctggcaaggcgcatagnnnnnnn

SEQ ID NO: 273369 - DNA, 455 bp, Homo sapiens
  misc_feature: GYAE6OF01COK8M.29.68.G02.1.454.CMB.1.raw
  modified_base (434)..(455): a, c, t, g, unknown or other
  misc_feature (434)..(455): n is a, c, g, or t
tcagatagagtactcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcacctggagtgggattacaaggcatacttcacactgggccggggcaccctggtcagcgtctcctcagcctccaccaagggcccatcggtcttcccctggccaccctcctccaacgacgcacctcgtgggggccaacgagcacgcccttggggctgcctggtcaaggtactacttccacgtacgacgtgctgagcgggactggcaaggcgcataggnnnnnnnnnnnnnnnnnnnnnn

SEQ ID NO: 273370 - DNA, 457 bp, Homo sapiens
  misc_feature: GYAE6OF01AKSB0.29.68.G02.1.454.CMB.1.raw
  modified_base (433)..(457): a, c, t, g, unknown or other
  misc_feature (433)..(457): n is a, c, g, or t
tcagatagagtactcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccacccaaggggccccatccggtcttccccctggccaccctcctccaacgagccacctctggggcacagcagccctgggctgcctggtcaaggactactccacgtagcgtgctgagcggggctgggcaagggcgcatagnnnnnnnnnnnnnnnnnnnnnnnnn

SEQ ID NO: 273371 - DNA, 565 bp, Homo sapiens
  misc_feature: GYAE6OF01CAAS2.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtgaagggccgattcaccatctccagagacaacgccaagaactcactgtatctgcaaatgaacaccctgagagccgaggacacggctgtgtattattgtgcgagagttgaaccacgtagttttggggcggcccgaacgaagactattactactacggcatggacgtcgtggggaccaaggcaccgaccggtccacccgtctcctcacgccctccaccgaacggccccacgtcccggtccttcccccgtcggccctacccctccctcccaacgacgccacccgtcgtcgggg

SEQ ID NO: 273372 - DNA, 517 bp, Homo sapiens
  misc_feature: GYAE6OF01AN6HX.43.79.H02.1.454.CMB.1.raw
  modified_base (207)..(207): a, c, t, g, unknown or other
  misc_feature (207)..(207): n is a, c, g, or t
  modified_base (472)..(472): a, c, t, g, unknown or other
  misc_feature (472)..(472): n is a, c, g, or t
tcagtgtgagtagtcacgaccggtgctcgatttagtgtcacacgaagggaaaggggcgagcttcagctgtcggtagagaagacaggattcaggacaatctccagcatggccggcttccctctcctcctcaccctcctcactcactgtgcagggtcctgggcccagtctgtgctgactcagtcaccctcagcgtctgggacccccggnagagggtcaccatctcttgttctggaagcagctccaacatcggaagtaattatgtatattggtaccagcagctcccaagaccggcccccaaattcctcatctataggaataatcagcgccctcagggtccctgaccgattctctggctccaagtctggccacctcacgccctcctggccatcagtggcctcccggtccgaggactggagtctgatttatactgtgcagcatggatgacagcctgacgtggtgtggtagttcgggnggaggaccagcgtagacccgtcgtagtccaggtcccaagggtccc

SEQ ID NO: 273373 - DNA, 550 bp, Homo sapiens
  misc_feature: GYAE6OF01EJ1KO.43.79.H02.1.454.CMB.1.raw
  modified_base (537)..(537): a, c, t, g, unknown or other
  misc_feature (537)..(537): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtgaagggccgattcaccatctccagagacaacgccaaagaactcactgtatctgcaaatgaacaccctgagagccgaggacacggctgtgtattatgtgcgagagttgaaccacgtattttggggcgcccgaacgaagactattactactacggcatggacgtcgtggggccaaggcaccgacggtcaccgtctcctcacgcctccaccgacggcccagtccggtccttccccgtcggcccaccctccctcccaacgacgcnccgtcgtcggggg

SEQ ID NO: 273374 - DNA, 384 bp, Homo sapiens
  misc_feature: GYAE6OF01CW58H.43.79.H02.1.454.CMB.1.raw
  modified_base (380)..(384): a, c, t, g, unknown or other
  misc_feature (380)..(384): n is a, c, g, or t
tcagtgtgagtagtcacgaccggtgctcgatttagtgtcacacgaagggaaagggccgattcaccatctccagagacaacgccaagaactcactgtatctgcaaatgaacaccctgagagccgaggacacggctgtgtattattgtgcgagagttgaaccacgatttttggggcggcccaacgaagactattactactacggcatggacgtctggggccaaggcaccacggtcaccgtctcctcagcctccaccaagggcccatcggtcttccccctggcaccctcctccaagagcacctctgggggcacagcggccctggctgcctggtcaaggactacttccactactcacactgagcgggctggcaaggcgcatagnnnnn

SEQ ID NO: 273375 - DNA, 534 bp, Homo sapiens
  misc_feature: GYAE6OF01BF5C7.43.79.H02.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
tcagtgtgagtagtcacgaccggtgctcgatttagtgtcacacgaagggaaaggggcagcttcagctgtggtagagaagacaggattcaggacaatctccagcatggtcggcttccctctcctcctcaccctcctcactcactgtgcagggtcctgggcccagtctgtgctgactcagtcaccctnagcgtctgggacccccggnagagggtcaccatctcttgttctggaagcagctccaacatcggaagtaattatgtatattggtaccagcagctcccaagaacggcccccaaattcctcatctataggaataatcagcggcctcgagggtccctgaccgattctctggctccaagtctggccacctcacgccctccctggcccatcgagtcgggctcccggtcgaggatggagctgattattactgtgcagctagtgggatgactagcctaggagtgggtgtggtagttcgggcggtagggaccgaaggccgtacggacccgtccgtaggtccacggcccgaagggtccc

SEQ ID NO: 273376 - DNA, 383 bp, Homo sapiens
  misc_feature: GYAE6OF01B4EY2.43.79.H02.1.454.CMB.1.raw
  modified_base (381)..(383): a, c, t, g, unknown or other
  misc_feature (381)..(383): n is a, c, g, or t
tcagtgtgagtagtcacgaccggtgctcgatttagtgtcacacgaagggaaagggccgattcaccatctccagagacaacgccaagaactcactgtatctgcaaatgaacaccctgagagccgaggacacggctgtgtattattgtgcgagagttgaaccacgatttttggggcggcccaacgaagactattactactacggcatggacgtctggggccaaggcaccacggtcaccgtctcctcagcctccaccaagggcccatcggtcttccccctgacaccctcctccaagagcacctctgggggcacagcggccctgggctgcctggtcaaggactacttccactactcacactgagcgggctggcaaggcgcatagnnn

SEQ ID NO: 273377 - DNA, 549 bp, Homo sapiens
  misc_feature: GYAE6OF01AWO9J.43.79.H02.1.454.CMB.1.raw
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
  modified_base (464)..(464): a, c, t, g, unknown or other
  misc_feature (464)..(464): n is a, c, g, or t
tcagtgtgagtagtcacgaccggtgctcgatttagtgtcacacgaagggaaagggcagcttcagctgtggtagagaagacaggattcaggacaatctccagcatggccggcttccctctcctcctcaccctcctcactcactgtgcagggtcctgggcccagtctgtgctgactcagtcaccctnagcgtctgggacccccggnagagggtcaccatctcttgttctggaagcagctaccaacatacggaagtaattatgtatattggtaccagcagctacccaagaaccggccccaaattcctcatctataggaataatcagcggccctgacgggtccctgaccgtattctcgtggcctccgaagtctggaccacctcacgcctccctggccatccagtcgggtctcccggtccgaggtactgacggtctgtattagttactgtgcgagctagtgggatgacngcctgacggtggtgtggtacgttcgggacggtaggaccgaggccgtacggaccgttcgtacggtacgacgtcccgaagggtcccg

SEQ ID NO: 273378 - DNA, 549 bp, Homo sapiens
  misc_feature: GYAE6OF01EQP04.43.79.H02.1.454.CMB.1.raw
  modified_base (537)..(537): a, c, t, g, unknown or other
  misc_feature (537)..(537): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtgaagggccgattcaccatctccagagacaacgccaagaactcactgtatctgcaaatgaacaccctgagagccgaggacacggctgtgtattatgtgcgagagttgaaccacgtagttttggggcggcccaacgaagactattactactacggcatggacgtcgtgggccaaggcaccacggtcaccgtctcctcacgcctccaccacggcccacgtccggtccttccccctcggcccacccctccctcccaacgacgccnccgtcgtcgggg

SEQ ID NO: 273379 - DNA, 387 bp, Homo sapiens
  misc_feature: GYAE6OF01DE8EF.43.79.H02.1.454.CMB.1.raw
  modified_base (382)..(387): a, c, t, g, unknown or other
  misc_feature (382)..(387): n is a, c, g, or t
tcagtgtgagtagtcacgaccggtgctcgatttagtgtcacacgaagggaaagggccgattcaccatctccagagacaacgccaagaactcactgtatctgcaaatgaacaccctgagagccgaggacacggctgtgtattattgtgcgagagttgaaccacgatttttggggcggcccaacgaagactattactactacggcatggacgtctggggccaaggcaccacggtcaccgtctcctcagcctccaccaagggcccatcggtcttccccctgacaccctcctccaagagcacctctgggggcacagcggccctgggctgccctggtcaaggactacttccactactcacactgagcgggctggcaaggcgcatagnnnnnn

SEQ ID NO: 273380 - DNA, 556 bp, Homo sapiens
  misc_feature: GYAE6OF01D6PUB.43.79.H02.1.454.CMB.1.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (340)..(340): a, c, t, g, unknown or other
  misc_feature (340)..(340): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctcgggacccccgggnaggaggtcaccatctcttgttctggaagcagcctaccaanatcggaagtaattatgtatattggtaccagcagctaccaagaccgaccccaaattccncatctanagaataatcagcgccctgacgggtcccngaccgattctctgcctacaagtctgcacctcacgcctccctcggccatccgaggtcgggcctccgggtccgaggtagtggaggtcgtgtaatttacttacgtgtcgacagtcagtagggactagaacacgtccgtgtacggtggtggttgggtagttcgggacgggtaggaccaagcgtcgacccgttccgtacggtcaacggcccgagggtcccg

SEQ ID NO: 273381 - DNA, 629 bp, Homo sapiens
  misc_feature: GYAE6OF01C2VKT.43.79.H02.1.454.CMB.1.raw
  modified_base (420)..(420): a, c, t, g, unknown or other
  misc_feature (420)..(420): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctgggacccccggcagaggtcaccatctcttgtctggaagcagctcaacatcgaagtatatgtatattggtaccagcagctccaagaacggcccccaaaattccacatctaataggaataatcaagcgccctcgacggggtccctagaccgtattctacgttcggcctaccaaagtcctacggcacctcacgtccctcccgtgcccatcagtcggctccggtcgagacngacggcttaggattagttactgtcgcgagctagtgggtaactcggaacgacgtcccgttagggtaagtttcggggttaggttacgggtttaaggtttcccgggggaccggggtaaggggaaacccctaaagggtacccgttacgggtaccccgggttacccgtaaggggtttaccccaaccgggacccccgtaaaggggttccccccgg

SEQ ID NO: 273382 - DNA, 573 bp, Homo sapiens
  misc_feature: GYAE6OF01AMADX.43.79.H02.1.454.CMB.1.raw
  modified_base (369)..(369): a, c, t, g, unknown or other
  misc_feature (369)..(369): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctgggtcaagccgtggggggtccctgagactctcctgtgcagcctctggattcacctttcagtgaagggccgattcaccatctccagagacaacgccaagaactcactgtatctgacaaatgaacaccctgagagccgagacacggctgtntattatgtgcgagagttacgaacctacgtagttttggggcggacccgaacgaacgactattactacgtacggcagtggacgtcgtgggaccaaggcaccgacggtccaccgtctcctcacgcctcccaccaacggcccacgtccggtcccttcccccgtcggcccacccctccctacccaacgacgccacccgtcggtccgggg

SEQ ID NO: 273383 - DNA, 775 bp, Homo sapiens
  misc_feature: GYAE6OF01C258D.43.79.H02.1.454.CMB.1.raw
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
tcagtgtgagtagtcacgaccggtgctcgatttagtgtcacacgaagggaaaggggcagcttcagctgtggtagagaagacaggattcaggacaatctccagcatggccgcttccctctcctcctcacctcctcactcactgtgcagggtcctgggcccagtctgtgctgactcagtcaccctnagcgtcgcgggacccggnagaggtcacatctcttgtctggaagcagcctaccaaactagtacggaaagttaattagttgtaattagttcggtaaccagccaagtacctacccgaaaggaacccggtaccccctaaaatttccctactaacgtacctaagtaaacggtaaactaaacgtccgaacggcccggtcccctacgggaaccgggggttccccttacgaacccggttaattccgttaccgtcggacccttaccgtaaacggtccgttacgggacccctaaccgttcgaaccgtccccgtcccggttacgggaccctacgtaccggtaacggtcgggtacccgttcccgggtaacggaggtacgtggaaccgggtctttaggtaactttacgttaacgttcggtgaccgtaaggtccgtaaaggttcggggaacttacgggaaccgtacgggtccgttagggtacggttggggtagggttaacggttacgggtaccgggggacgggaaacggtaccgtaacgggtcgttaaccgggtaccccggttacgtaacgggaccctaccgggaaaccccgtgggttacccccg

SEQ ID NO: 273384 - DNA, 545 bp, Homo sapiens
  misc_feature: GYAE6OF01CFOWH.43.79.H02.1.454.CMB.1.raw
  modified_base (187)..(187): a, c, t, g, unknown or other
  misc_feature (187)..(187): n is a, c, g, or t
  modified_base (302)..(302): a, c, t, g, unknown or other
  misc_feature (302)..(302): n is a, c, g, or t
  modified_base (460)..(460): a, c, t, g, unknown or other
  misc_feature (460)..(460): n is a, c, g, or t
tcagtgtgagtagtcacgaccggtgctcgatttagtgtcacacgaagggaaaggggcagcttcagctgtggtagagaagacaggattcaggacaaatctccagcatggccggcttccctctcctcctcaccctcctcactcactgtgcagggtcctgggcccagtctgtgctgactcagtcaccctnagcgtctcgggacccccggcagagggtcaccatctcttgttctggaagcagctccaacatcggaagtaattatgtatattggtacagcagctccaagaacggcccccaaattccncatctataggaataatcagcggccctcgacggggtccctgaccgattctcgtggcctccaagtctcggcacctcagccctccctggcccatcaggtcgggcttcccggtccgaggatggacggctggatttattacgtgtgcagctagtgggatgacngccgtgaggtggtggtggttagttcgggacgggagggaccgaggccgtaggacccgtccgtagggtcacggcccgaaggtccccg

SEQ ID NO: 273385 - DNA, 570 bp, Homo sapiens
  misc_feature: GYAE6OF01BMRN2.43.79.H02.1.454.CMB.1.raw
  modified_base (300)..(300): a, c, t, g, unknown or other
  misc_feature (300)..(300): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaccttcagtgaaggccgattcacatctcaganacaacgccaagaactcactgtatctgacaaatcgaaacacccgtagagacgaccgaggacacggctgtagtattagtgtgacgagagttcgaacctacgtagttttggggcgaccgaacgaacactatactacgtacgcagtcggacgtcgtgggaccaacggcaccgacggtaccacccgtctcctacacgccctccgaccgacggcccacgtccggtcccttccccgtcggcccaccctcctaccacgacgccaccgtcgtaccgggg

SEQ ID NO: 273386 - DNA, 645 bp, Homo sapiens
  misc_feature: GYAE6OF01CECVI.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctgattcaccttcagtgaaggccgattcaccatctccagagacaacgccaaagaactcactgtatctgacaaatgaaccaccctagacgacgccgaggacacggctgtatattattgtgacgtagacgttagaaccgtacgttaggttttcggggaccggtaccccgaaacggaaacggtaacttaagttaaccttaaccgtaacggtaccaagtcgggaccgttcgtacggggaccaacgggccaacccgaccggtaccgtacccgtcctccctacacgccctaccgaacccgaaccgggccctaacgtcccggttcccttccccccgtcggcccctacccctacccgtacccaacgacgcccaacccgtccggtaccggggg

SEQ ID NO: 273387 - DNA, 752 bp, Homo sapiens
  misc_feature: GYAE6OF01CE400.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtggggggaggcctggtcaaggccgtggggggtccctgagactctcctgtgcagcctcgtggacttcaccttcagtggaagggccgattcaccatcctccagacgacaacgccaagactcactgtactctgacaaatcgaaccacccgtggaagacgaccggaaggaccgacgggcttggtagttaatttagttaggtgtacggtaggtacggttacgaaacccgtacggttacgggtttttacgggggccccggtaacccgtaaacggtaacgtaacttaacgttaaccgttaaccgtaacggtactacggttacgggtaccggttccggtacggggaccgaacgggaccgaacccggtaccgggtaccctacccgttcccgttacccgtaccacccggtacccctacccgaacccggaaacccgggccccgtacccgttcccgggttacccccgtttccccccggtcccggtacccctacccccccgttaccccgtaacccaacccggaccgaccccggttaccccgtcggggtacccggggg

SEQ ID NO: 273388 - DNA, 679 bp, Homo sapiens
  misc_feature: GYAE6OF01DFUNU.43.79.H02.1.454.CMB.1.raw
  modified_base (407)..(407): a, c, t, g, unknown or other
  misc_feature (407)..(407): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtgggggtccctgagactctcctgtgcagcctcgtggactttccaccttcgaggtaggaacgggccgtattcaccatcctccgagagaccaacgccaaagaacctacactagtatctagacaaatacgaaccaccgtgacgacgaccggaaggacgacggtctgtagttattagttgnggacgtagtacgttacgaaccgtacgttacggttttacggggaccggtaacccgaaacgtaacgtaacgttaacttaccgtaacgtaccggtactacgtacggtaccggttacggtacggggaccgaacggaccgaccgtaccggtaccgtacccgtcctccctaccaccgccctacccgaccgaccgggccctacggttcccgttccccgttccccgtcgacccctacccctacccgtacccgaacgccgacctcccgtcggtacccgggg

SEQ ID NO: 273389 - DNA, 868 bp, Homo sapiens
  misc_feature: GYAE6OF01D8CJ1.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctatttagaaggtgtccagtgtgaggtgcagctggtggagtcgtgggggaggccgtggtcaaggccgtggggggtcccctgacgactctcctgtgcagcctctggtattcaccttcagtgagggccgattcacactctccagagacaacgaccaaagactcacgtgtaatctagacaaagtacgaaccacccgtagacgacgaccggaaggacgtacggcgttagtagttagtttaatggtagacggtagtaggttacgaaccgtacggttacggttttacggggaccggtaccccgtaaaggtaacggtaaccttaaacgtttaaccgtaaccggttaacggtacgtaaggtaccgggtacggttaccggttacgggggaacccgtaaacgggacccgtaacccgggtacccgggttacccgtaaccccgtttaccccgttaccccgtaaccggtaaccccgggttacccctaaacccccggtaaacccccgggtaaaccccgggggtacccccgttaaaccccgggtttacccccggggttttcccccccggtttttacccccccccggttacccgggggtaaccccccctttaaccccccccggttaaacccccggtttaaccccccgaaaaacccgggtaacccccgggttacccccgttaaacccccggggttttcccggggggtaaacccccggggggg

SEQ ID NO: 273390 - DNA, 720 bp, Homo sapiens
  misc_feature: GYAE6OF01CXHMJ.43.79.H02.1.454.CMB.1.raw
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtccaccctcagcgtcgtcgggacccccgggcaggagggtccaccattctcgtttgttctggaacgcagcctaccaacagtacggaaagttaattattgtattagttcggtaaccagcagcctaccccgaaagaaccccggaccccctaaattccctactacttactaacgtaaggaaataacgtcgacgccggccctcggaccggggtccctacggaccgtattcctacgtcggcctaccgaacgtcgtacggccctacctcgaccgtcccctcccgttcggacctacgtcgtacgggtcgggcccgttcccgggtccggaaggtagtcgggtacgtcgttaggttaactttagtttacgttggtcgactacggctagggtagggtaagtcggacgtacgtccgttaggtagggtgggttagggttcgggttacggttccgggggacgggtaaaccggggtaacgaaaccggttcgttaacccgggacccggtttacccggttaacggggtcccgaaacgggtccccgtaagggtcccccgg

SEQ ID NO: 273391 - DNA, 776 bp, Homo sapiens
  misc_feature: GYAE6OF01DYZ0G.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctggagactctcctgtgcagcctctggattccaccttcaggtgaacgggccgtattcaccatcctaccagagacaacgaccaagactcactgtactctgacaatgaaccacctagagacgccggaaggaccacggtctggttacgttaatttagtttgtggtacggtaaggtacgtttacgaaccgtaacggttacggtttttcgggggaccggtacccgaaacggtaacgtaacttaacgtttaaccgttaaccgtaccggacgtaggtacgggtaccggttacgggtacgggggtacccgaacgggacccgaacccggtaaccgggttaccccgtacccggttaccctaccccgttaccgacccgtaccccgttaaccccgaaacccggtaaacccggggtaccccctaaccgggttccccgggtttacccccgtttcccccccggttcccggggacccccttaccccccgttaccccgtaaccccgaaacggtaccgacccctaaccccgggttccgggtaaccccggggggg

SEQ ID NO: 273392 - DNA, 650 bp, Homo sapiens
  misc_feature: GYAE6OF01CSZD5.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaaggccgtggggggtccctgagactctcctgtgcagcctcgtggtattccaccttcaggtagaagggccgtattcaccatcctcagagacaacgccaagactcactgtatctgactaaatacgaacctacccgtagaagacgaccggaaggaccgacggctgtagttaatttagtgtggcgtagtagttacgaaccgtacgttaggttttcggggaccggtacccgaaacgtaacgtaacttaacgttaactaacgtacggtactacgtcggtacgtcgtacggggaccgaacggaccgaacccgtaccggtaccgtacccgtcctccctaccgacgccctaccgaccgaccggtccctaccgtccgtcccttccccgtcggccctaccccgtccctaccacgacgcccgtccgtcggtaccgggg

SEQ ID NO: 273393 - DNA, 629 bp, Homo sapiens
  misc_feature: GYAE6OF01BH8QD.43.79.H02.1.454.CMB.1.raw
  modified_base (610)..(610): a, c, t, g, unknown or other
  misc_feature (610)..(610): n is a, c, g, or t
tcagtgtgagtagtcacgaccggtgctcgatttagtgtcacacgaagggaaagggggagagaggagccttagccctggattccaaggccctatccacttggtgatcagcactgagcaccgaggattcaccatggaactggggctccgctgggttttccttgttgctattttagaaggtgtccagtgtgaggtgcagctgggtggagtcgtgggggagcctggtcaagccgtggggggtccctgagactctcctgtgcagcctctggacttcaccttcagtggaacgggccgattcaccatcctccagacgacaacgccaagaactcactgtactctgacaaatcggaaccaccctgaacgacgaccgaaggaccacggctggtagttattagttgtgcgtagtagttacgaaccgtacggttaggttttcggggaccggtacccgaaacgaaacgtacgtaacttaacctacgtacggacagtcgggacgtcgtacgggaccaaggccaaccgtacggtacctaccgttctccgtacgacgtcctaccgaccgacggccctacgtcccgtcccttcccccgtcgcccctaccctcccgtaccaacgaccncctaccgtcggtaccgggg

SEQ ID NO: 273394 - DNA, 549 bp, Homo sapiens
  misc_feature: GYAE6OF01E2E2Z.43.79.H02.1.454.CMB.1.raw
  modified_base (303)..(303): a, c, t, g, unknown or other
  misc_feature (303)..(303): n is a, c, g, or t
  modified_base (383)..(383): a, c, t, g, unknown or other
  misc_feature (383)..(383): n is a, c, g, or t
  modified_base (423)..(423): a, c, t, g, unknown or other
  misc_feature (423)..(423): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctgggacccccgggcagagggtcaccatcctcttgttctggaagcagctccaacatcggaagtaattatgtatattggtaccagcagctcccaagaccggccccaaattccncatctataggaataatcagccggccctcgacggggtccctgaccgattcctcgtggcctccgaaagtctcggcacccgtnacgccctcccgtggccatcagtcggcctcccggtcgaggntcggaggtctaggtatttattacgtgtgcagcagtgggatgacagtcctggacgtggtcgttggtacgttcggcgggtagggaccaaggcgtcggacccgttcgacggtcacgcccgaaggtcccg

SEQ ID NO: 273395 - DNA, 749 bp, Homo sapiens
  misc_feature: GYAE6OF01BONSC.43.79.H02.1.454.CMB.1.raw
  modified_base (254)..(254): a, c, t, g, unknown or other
  misc_feature (254)..(254): n is a, c, g, or t
  modified_base (341)..(341): a, c, t, g, unknown or other
  misc_feature (341)..(341): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagcctggtcaagccgtgggggtccctgagactctcctgtncagcctgtggattcacctttcagtgaaggcctattccacatctcagagacacgaccaagactcatgtatctagactaaagtcgaacncccgtagacgacgccggaaggtaccacggcttggtagttacgtttatggtaggacgtaggtacgttacgaaccgtacgttaggtttttcggggaccggtacccgaaacggtaaacgtaacttaacgttaaccgttaacgtaacggtacgtaacggttacgggtaaccggttccggtacggggacccgtaacgggacccgtaaccggtaacccggtcccgtaacccggttccttaccccgtacctacccgtccccgttacccgaacccggtaacccgggtaccccgtaaccggttcccgggtttcccccgttaccccccggttcccggtacccccgtaccccccttaccccgtaaccccgtaaaccggtacccggtacccctaccccggtccggttaaaccccgggggg

SEQ ID NO: 273396 - DNA, 692 bp, Homo sapiens
  misc_feature: GYAE6OF01CJYPA.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagccgtggggggtccctgagactctcctgtgcagcctctgattcacttcagtgaggccgatcacatctcagagacaacgccaagaactcactgtatctagacaaatacgaaccacctagacgacgaccgacggacgacggtctgttagttattattggtgacgagtagttacgaaccgtacgtacggtttttcggggaccggtacccgaaacggaaacgtaacgttaattacgttaacgtaacggtactacgtgggtaccgttacggtacgggacgtaacggaccgaacccggtaccgggtaccgtacccgttccgttccctaccgacccgtcccgtaccccgaacccggtaaccgggacccctaaccggttccccggttccccgttaccccccggtccggtacccctaccccccgtacccctacccgaaaccggtaccgacccgtaccggtcccggtaccgggggg

SEQ ID NO: 273397 - DNA, 517 bp, Homo sapiens
  misc_feature: GYAE6OF01D9JAO.43.79.H02.1.454.CMB.1.raw
  modified_base (207)..(207): a, c, t, g, unknown or other
  misc_feature (207)..(207): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (434)..(435): a, c, t, g, unknown or other
  misc_feature (434)..(435): n is a, c, g, or t
  modified_base (503)..(503): a, c, t, g, unknown or other
  misc_feature (503)..(503): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctcgggacccccgggnagagggtcaccatctcttgttctggaagcagctaccaacatcggaaagtaattatgtatattggtaccagcagctcccaagaaccggcccccaaattcctcatctaataggaataatcaagccgccctcgacgggtccctgaccgattctctggctcaagtctggccacctcagtccctcctcggccatcagtcggctccggtcgagntgagtntgattatactgtnnagcagtggatgacacgcgtagagtggtgtggtagttcgggcgagggaccagctacgaccgtctacggnacgccgaggtcccg

SEQ ID NO: 273398 - DNA, 871 bp, Homo sapiens
  misc_feature: GYAE6OF01DC1KE.43.79.H02.1.454.CMB.1.raw
  modified_base (215)..(215): a, c, t, g, unknown or other
  misc_feature (215)..(215): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcacgtccaccctcacgccgttcgtccggggacccccgggnagggacgggtccaccgattccttcttgtttccgagggaacgccacggtcctaccaacgtacgtacgggaaagttaatttataggttaatttacgttacggtaccaggaccacgtaccctaacccgaaacggaaccccggtacccccctaaaacttttcccactacttacgttaagtaacggtaaacttaacgtaccgagggtccccggtccccgttaccggtacgggggttacccctacggtaccccgttacgttttcccgtaccggttcgggtacccttaacccgtaacggttccgttacggccctaccgtaccgccgttcccccttcccggtacggaccctacgtaccggtacgggttccgggcccgttaccccggggttaccgggaacgtacgggtcgggtaacgggtacgtttaggttaaccttttacgtttaccggtcggtagaccggttaacgcggttaacgggttacgggtacgtacggtaaccggccgttaccggttagggaaccggggtttgggttacgggttacgggtttacgggtcggggaacccgggggacggggttaaaccgaacggtccccgttacggtaaccccggggtttacccgtaagggtacccgtaacccggggccccgttaaaggggtccccccgg

SEQ ID NO: 273399 - DNA, 725 bp, Homo sapiens
  misc_feature: GYAE6OF01B4ACH.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgtgcagcctctggattccaccttcagtggaacgggccgtattccaccatcctccagagaaccaaccgccaaagacctcactgtatctgactaaatcgaaccacccgtaggacgaacggccggaagggaccacgggtctggttattaagtttagttggtagtcggaaggtacgttacgaaccgtacggttaggtttttcggggaccggtacccgaaacggtaaacgtaaccttaagtttaactttaaccgtaaccggtacaaggttacggaccgttcggtacggggacccgaacgggccaacccggaccgggtaccctacccggttccttcccgtaccaccgtacccctacccgaaccgaaccgggacccctaaccgtcccggttaccccgttccccccgtcggtaccccctacccccgttaccccgtacccgtaacggaccgtacccgtaccccggtccgggtacccggggg

SEQ ID NO: 273400 - DNA, 955 bp, Homo sapiens
  misc_feature: GYAE6OF01CEJBO.43.79.H02.1.454.CMB.1.raw
tcagtgtgagtagtcacgaccggtgctcgatttagtgtcacacgaagggaaagggggtagagaggagccttagccctggattccaaggcctatccacttggtgatcagcactgagcaccgaggattcgaccatggaactggggctccgcttgggttttccttgttgcttagttttagaaggttgtcagtgtcgaggtgcagtctggtggagtcgtggggagccgtggtcaacggtccgtagggggtccctgacgactccgtccgtgtacgccgtacgccttcgtggtaacttccgtaaccttcgaggttgaaccggggtcctattaccgaccacgttcctaccgaggacgtaaccgaaccggtacccgaaacgtaaccgtccctaacgttcggttaacttccggttaagaaccgttaaacttacggaaacccgtaccgttacggacggtaaccgtacccggaagggtaacccggtacgggtaccgttacggttaaggtttaacgttttacggttacggttaggtaacccggtagggttaacggttacccggtaaaccgttaccggggtttaaggtttttaccgggggggaccgtaaaccccggtaaacgggtaaacgttaaccgtttaaaccgttacccggttaaccgtaaccgggttaccgtaacggttcgggtaacccggtttacggtaccggggtaacccgtaacgggtaccccgttaacccggtaacccggggttaccccgttaaacccggtttccccgttaacccggttaccccgtaccgggttacccccgtaacccggtaaccccgggaaacccggttacccccgtaccgggttttaccccgggttcccccgtttaaccccggttcccgggtaccccctaacccccgtttacccgtaacccggttaacgaaccccgtaccggttaaccccggttcgggtaacccggggg

SEQ ID NO: 273401 - DNA, 571 bp, Homo sapiens
  misc_feature: GYAE6OF01AXVRP.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggggaggcctggtcaagcctggggggtccctgagactctcctgtgcagcctctggattcaccttcagtgaagggccgattcaccatctccagagaccaacgccaaagaactcactgtatctgacaaatgaacaccctgagagccgaggacacggctgtgtattatgtgcagtagtgacagtagttttggggcggaccaacgaacgactaattactacgtacggactagtaggacgtcgtgggccaaggccaaccgacggtcctaccgtctcctcacgtccctaccaccgaacggcccgagtcccggtcccttcccctcggccctacccctccctaccaacgaccgccacccgtcgtccgggg

SEQ ID NO: 273402 - DNA, 706 bp, Homo sapiens
  misc_feature: GYAE6OF01EIKLO.43.79.H02.1.454.CMB.1.raw
  modified_base (144)..(144): a, c, t, g, unknown or other
  misc_feature (144)..(144): n is a, c, g, or t
  modified_base (220)..(220): a, c, t, g, unknown or other
  misc_feature (220)..(220): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactnacgcgagggtccggtcggcccgacgtacgtcgtcgacttagactcagtcaccctcagcgtcgtcgggacccccggnaggagggtcaccatctcttgtctggaagcagctccaaacagtacggaaattaattagtgtaatagttaggaccagcagcctacccaagaacccggaccccaaattcctacatctataaggaataatcagcgccctcgacgggtccctggaacctcttctcgtggcctaccgaagttccgcggaccacccgttcacgtccctcccgttaggccctaagtccgtagggtcgggacccgttacccgggtccggaaggtacgttaggaacgggtccttacggttaattttaaccgttcgtttaacggtagtaccgaacgtacgtaggtttaccggggaattaaccgggaaccgtaacgtccgttaggaagggttgggttacgggtaggttacggtttaccggggacggggtaacgggaaccgtacggtaccgtaccgtaaccccggttccgtaaacggtccgaaccggttacccgaacgggttcccccgg

SEQ ID NO: 273403 - DNA, 735 bp, Homo sapiens
  misc_feature: GYAE6OF01EJOX1.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggacggccgtggtcaaggccgtggggggtccctgagactctcctgtgcacgcctcgtggacttccaccttcgagtacgaacgggccgtattccacatcctaccagacgacaacgaccaagactcactgtatctgacaaatacgaaccaccgtagaacgacggaccggaaggaccgacggtctggttagttaatttagttggtaggacgtaaggtacggttacgaaaccgtaacggttacggtttttacgggggaccggtaacccgaaacggtaaacgtaacgttaaacgtttaaccttaaccgtaaccggtactacgtacgggtaccgtacggtaccggggacccgaaacgggaccgtaacccgtacccggtaccgtaacccgttaccgttacccgtaccgtaccgtaccctaccccgaacccggtaaccgggtacccctaacgttcccggttaccccgttacccccgtccggacccctacccctacccgtacccaaacgaccgacctaccgtcggtaccgggg

SEQ ID NO: 273404 - DNA, 907 bp, Homo sapiens
  misc_feature: GYAE6OF01DK6CT.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaacgtggggctccgcttgggttttccttgttgtcttattttagaaggtgtccagtgtgaggtgcagcgtgggtggagtcggtgggggacggtccgtggtacgaacggtccggttcgggggggtcccctaggacgtaccttccgtccgtgtcgcacgtccttcgtggtacttcctaccttcgaaggtcggaacgggtcctagttaccaacctactcctaccgagaacgaaccaaccgaccaaacgaacctcgaactgtaactcgacaacaaactacgaacccgtaccgtaggaacggaacggacccggtaacggaacgtaccggtcgttaggttacgtttaagttttacgttcgggtacggtacggtaggttaacgtttaaccggtaacccggttacggtttaaccggggtttttaccgggggaacccggtaaccccggtaaaaccggtaaaccgttaaccgttaaaccgtttaacccgttaaccgggttaaccggtaacgtaacgggtttaaccgggtaccggttacccgggtaaccgggggtaacccgaaaccgggtacccgtaaaccccggtacccgggttaacccgtaccccggttacccgttacccgtaacccgacccgtaaccccgttaccccgaacccggaaacccgggtacccgtaaccggtttccccggttaccccgttcccccggtcccggacccccttacccccgttacccgtaaccccgtacggtaaaccgtcccccgtaaccggttcccgggtaacccgggg

SEQ ID NO: 273405 - DNA, 822 bp, Homo sapiens
  misc_feature: GYAE6OF01C7XTJ.43.79.H02.1.454.CMB.1.raw
  modified_base (210)..(210): a, c, t, g, unknown or other
  misc_feature (210)..(210): n is a, c, g, or t
tcagtgtgagtagtcacgaccggtgctcgatttagtgtcacacgaagggaaaggggcagcttcagctgtggtagagaagacaggattcaggacaatctccagcatggccgcttccctctcctcctcaccctcctcactcactgtgcagggtcctgggcccagtctgtgctgactcagtccaccctcacgcgtccgtcggggacccccggnaggacggtccaccattccttccgtttgttcgtaggaacgtcacgaccttaccaaactacgtacggtaaaagttaattagttagtaacttagttacgggtaacccagcctaacgtaccctaaccccgaaacggtaaccccgtaaccccctaaatttccctaactaacgttaccgtaagtaacggtaataactccgacggcccggtaccctacgggtaccgggtccctacggtacccgttactttccgtaccgtcggtacccttaaccgaacggtttccgacgggtaccctacccgtaccgtaccgtccccgttacccggttaccgaccctacgttaccggtacgggttcccgggacccgttacccgggtaccggaaggtacgtcgggacgtcgttagttaactttacgttacggtcgtacggaccgtacgtaacgtagggttacggacgtacggactacggttccggtaggtcgggtttagggttacgggttacgggtttaacgggtccgggggaacgggtaccggtaaccgtacgggtcccggttaacccggtacccgggttcggtaaccgggttacccgaaccccgggttaccgggacccggttaccccgg

SEQ ID NO: 273406 - DNA, 805 bp, Homo sapiens
  misc_feature: GYAE6OF01B9AX1.43.79.H02.1.454.CMB.1.raw
  modified_base (640)..(640): a, c, t, g, unknown or other
  misc_feature (640)..(640): n is a, c, g, or t
  modified_base (795)..(795): a, c, t, g, unknown or other
  misc_feature (795)..(795): n is a, c, g, or t
tcagtgtgagtagtcacgaccggtgctcgatttagtgtcacacgaagggaaagggcagcgttcagctgtggtagagaagacaggattcaggacaatctcagcatggccggcttccctctcctcctcaccctcctcactcactgtgcagggtcctgggcccagtctgtgctcgactcacgtccacccttcgacgtccgtcgtaccggggacccccggcgacggagggtaccaccgtatccttcgtttcgttcgtaggaacgtccgaacggtcctaacccaaacgtacgtaaccgggtaaattaaacgtttaattagttaacgttaagttttacgggttaaacccaggtaccaacggtaccgtaccccgtaaaacggaacccccggtacccccgtaaaaccttcccttacctaactttaccgtaaacgtaacggtaaaacttacgtaccgaaccgggtacccggtacccgtaccgggtaccggggttaccccgtaccggaaccgttaacgttcccgtcgtacggtacccgtaaccgtaaacggttccgtacgggtaccctacccgttccgacgtccccttcccggtacggtacctacgtaccgtacggtaccgggttccctacccgggttaccggacggtanacggtacggacttgtaactttacgttagtcggttcacgtacgtacgtagtagggtcttacggaactcgtaccgtgtacggtggtacgtcggttaggtccggacggtagggaactaaggccgttaacgccggttaccgtaggtaccacgtaccggnggtacccccg

SEQ ID NO: 273407 - DNA, 887 bp, Homo sapiens
  misc_feature: GYAE6OF01CPEW9.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactgggggctccgcttgggttttccttgttgcttattttagaaggtgtcagtgtgaggtgcagctgggtggagtcgtgggggagcctggtcaagccgtggggggtccctgacgactctccgtgtcgcacgcctcgtggtactttccaccgttacgaggtacggaacggggtccctaagtttccaacctacttcctaccgaaggaacgaaccaaaccggaccaaaacggtaacctcgtaacctagttactacgtagaacctaaagtacgaaacccaccgtaggaacgacgaccggaacggacgaccggtcgttacgtagtttaagtttgtttagggtacggtaccggtaaggtaacggtttaccggtaaacccgttaacgggtttacgggttttttaccggggggaccccggtaaacccggtaaaaccggtaaacggtaacctttaaacgtttaaccttaaccggttaaccggtaacgtacgggtacgggttaccggttaccggggtaccggggtaaccgtaacgggacccgtaacccggtacccgggttacccgtaccccgggtttacccttccccgtaaccgtacccgtacccccgttaaccccgaacccggaaccccgggtccccgtaccgggtttaccccggttcccccgtttaccccccggtcccgggtaccccctaccccccgtttaccccgtaacccgaaaccggtacccgtaccccggtaccccggttccggggtaaccccggggg

SEQ ID NO: 273408 - DNA, 774 bp, Homo sapiens
  misc_feature: GYAE6OF01E4Q90.43.79.H02.1.454.CMB.1.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctcgggacccccggnagagggtcaccatctcttgttctggancagctaccaacatcggaagtaattatgtatattggtaccagcagcctacccgaaagaacccggaccccctaaattccctacataccttaagtaacggaaataactcgaacggcccggtacccctacggaccggggttccctacggaaccgtattcgtcgtacggccttaccgaacgttcgtacggaccctacccgttacgaccgtccccgttccccgtcgggtaccctacgtacccgacgggttaccggggtcccgttaccccgggtacccggtaagggtacgttacgggacggtccgttaggttaacttttacgtttacgtcggttacgaccgtaagtccgtaagggttacggggtaacttaggaacccgtaacgggtccgttacgggtaacgggttggggttacggttggggttaaccgggttcccgggggaaccggggtaaacggggtaacccgaagggtcccggttaccgggtaaccccggttacccggttaacgggttaacccgaaccgggtaacccccggtaagggttccccccg

SEQ ID NO: 273409 - DNA, 765 bp, Homo sapiens
  misc_feature: GYAE6OF01CM20B.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggccgtggtcaagccgtgggggtccctgagactctcctgtgcacgcctctggtacttccaccttcgaggtaggaacggggtcccgtactttccaccctacttcctccaaggaacgaaccaaccgaccaaagaacctcacttgtactctagacaaatgaaaccacccgtagacgacgaccggaagaccgacggcgttgtattaacttagttggtagacgtaggtagttacgaacccgtacggtttaggttttaccgggggacccgtaacccgaaacggtaaagtaaccttaacgttaaccgttaaccgtaaccgggaccgtaacgtacggggtacccgttcgggtacggggaacccgaacgggacccgaacccgtaccgggtacccgtacccggttacccttcccgtaccgaccgacccctacccgaacccggaacccgggtacccctaccggttccccggttaccccgtttccccccgccggtaccccctacccccgttaccccgtacccaaaccggtaccgtccccgacccgttccgggtacccggggg

SEQ ID NO: 273410 - DNA, 665 bp, Homo sapiens
  misc_feature: GYAE6OF01DOSX7.43.79.H02.1.454.CMB.1.raw
  modified_base (573)..(573): a, c, t, g, unknown or other
  misc_feature (573)..(573): n is a, c, g, or t
  modified_base (647)..(647): a, c, t, g, unknown or other
  misc_feature (647)..(647): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagcccgtggggggtccctggagactctcctgtgcagcctctggacttcaccttcagtggaacggccgtattcaccatctccagacgacaacgccaagaactcactgtatctagacaaatacgaaccacccgtagacgacggaccggaagggaccgacggtctgttacgttaattagtttggtacggacggtaagtaaggttacgaaaccgtaacggttacggtttttacgggggccggaaccccgaaacgtaaacgtaacttaacttaactaccgtacggtactagtacggtacggtacgtcgggaccgaacggccgaaccgacggtaccgtaccgttcctccctacnccgccctacccgaccgaccgggaccctacgtcccggttcccttccccgtcgaccctcccaccgtcccaacgacnccaccggtcgtaccgggg

SEQ ID NO: 273411 - DNA, 881 bp, Homo sapiens
  misc_feature: GYAE6OF01E2BNS.43.79.H02.1.454.CMB.1.raw
tcagtgtgagtagtcacgaccggtgctcgatttagtgtcacacgaaagggaaaggggcagcttcagctgtggtagagaagacaggattcaggacaatctccagcagtggcccggtcttcccctctcctcctccaccctcctcactcactgtcgcgagggtccgtcgggacccagttctgtgcctgtaactcacgtccaccctcgaggtccgtccgtaccgggggaccccccgggtagaacggacgggtccaaccgtattccgttccttttggttacctagggaacgcctagcccttacccgaaacgtacggttacggtaaattaatttaagttagttaactttaagtttcgggtaaccaggaccacgtaccccgtaacccgaaaacccggaaccccgtaccccctaaaactttcccctaagtacctacttaaagtaaaggtaaacctaaacgtccgtaaccggcccggtaccccgtacgggttaacccggggtccccgttacggtacccgttacgtttccgtcgttaccgggttacctaacccggtaacgtccgttaccggccctaacccgttacgtaccccgttcccgttaccccgtccgttacccgacttacccgggtacgggtccccggttccgggtaccccgggttacggacggtgttaccgggacggttacttacgttaactttacgttacgtgtacgctaagcggttagtacggtacgtagaaccgtacggtgtacggtgggttcgggttacggttacggtaccggggttaaccgggacggggttaaccgggaactaccgggtcccgggttaaccggtaacccggttcccggtaggggaaaccccgtacgggtaaccccccggtggtacccccgg

SEQ ID NO: 273412 - DNA, 788 bp, Homo sapiens
  misc_feature: GYAE6OF01C0EVT.43.79.H02.1.454.CMB.1.raw
tcagtgtgagtagtcacgaccggtgctcgatttagtgtcacacgaagggaaagggggagagaggagccttagcctggattccaaggcctatccacttggtgatcagcactgagcaccgaggattcaccatggaactggggctccgcttgggttttccttgttgcttattttagaaggtgtcagtgtgaggtgcagctggtggagtcgtgggggaggccgtggtcaagccgtgggggtccctggagctctccgtgtgcagcctcgtggatttcacctttcgagttggaacgggccgtattccgaccagtcctccgaaggacgaaccgaacggccaaagaactcctacgttgtactcgtagaactaaatcgaaacaccgtagagacgaccgaggacacgggtctagtgttaattattggtgacggagtacgttacgtaaccgtacgttacgtttttcggggaccggtacccgaacgtaacggtaacgttaacgttaaccgtaacgtacggacgtagtacggtaccgttcggtcgggaccgtaacgggacccgtaaccgtacccgggttaccgtaaccccggtttccgtacccgttacccgtacccggtcccctaacccccggtaaccccggaaaccccgggtaacccccgtttacccgggttacccgggtttcccccgtttacccccccggttacccgggtaacccccgttacccccggttaccccggttaacccccgtaaacggtaccccggtacccccgtaaacccgttcccggggttaacccggggg

SEQ ID NO: 273413 - DNA, 775 bp, Homo sapiens
  misc_feature: GYAE6OF01DNIEH.43.79.H02.1.454.CMB.1.raw
  modified_base (102)..(102): a, c, t, g, unknown or other
  misc_feature (102)..(102): n is a, c, g, or t
  modified_base (271)..(271): a, c, t, g, unknown or other
  misc_feature (271)..(271): n is a, c, g, or t
  modified_base (444)..(444): a, c, t, g, unknown or other
  misc_feature (444)..(444): n is a, c, g, or t
tcagtgtgagtagtcacgaccggtgctcgatttagtgtcacacgaagggaaagggggagagaggagccttagccctggattccaaggcctatccacttggtnatcagcactgagcaccgaggattcaccatggaactgggggcctccgcttcgggttttccttgttgcttagttttagaaggtgtccagtgtgaggtgcagtcgtggtgggagtcggtgggggacggccgtggtcaacggcccggtacgggggggtccctgacgtacttcnccgttgtgcgacgcctgtgtacttcctacttcgagtggaacgggcctataccgacctatcctaccgaggaactaccgaaacgcctaaaagacctaccgtacttagtataccgtagaactaaacgtacgtaacctcccgtaagacggtaccgaccggtaacgacccgtacgggntttaacgtgttagtttagttggtacggtacggtaaggttagttaacccgtaaccggtaccggtttacggtttttaccgggggacccgtaacccgaaacgtaacgtaacctttaactaaccgttaaccgtcgtacgtcggtacggtaccggtcggtacgggaccgaacgggaccgtaacccgtaccggtaccgtacccggttactcccctacgcctaccccgtaccgaacccggtaccggacccgtacggtcccgttccccgttccccgtccgggccccttaccccgtaccctaccgtaacgcccgtcccgttcccgtcggggtaacccggg

SEQ ID NO: 273414 - DNA, 822 bp, Homo sapiens
  misc_feature: GYAE6OF01AEJ7T.43.79.H02.1.454.CMB.1.raw
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctcgggcccagtctgtgctgactcagtcacctcacgcgtcgtcggggacccccgggcaggacgggtcacctactctcttgttcgtaggtaagcacgtcctaccaacacgttacgggtaaacgttaattacttagttaagttagtttacggtaacctacgtaccgacgtaccctacccgaaaccggaaaccccggacccccctaaacttccctacctactactaacgttaaggtaaactaacgttcgaacggtccggtacccgtaccggtacgggtccccgttacgaccgtacgttccgtcgtacggtcctaccgtaacgtcgtacggtaccctacccgttaccgaccgtacccgtaccccgtcggggtacccctacgtcccgggttacggggtcccggggtacccctttccccggggtaaccgggtacgggtaaggtacgggtcgggttacgttaaacgttaacgttttacgttaccggtacggttacgaccggtacgtcggtaacggggttacgacgttaccgacggtacgtacccggtaggttagggttcggttaggttaccgggtaccggtacggggtaccgggaacgggttacaccgggttacccgttacggggtaacccgttaccggtacggtaccggacccgtaacccgggtccggtccccgg

SEQ ID NO: 273415 - DNA, 798 bp, Homo sapiens
  misc_feature: GYAE6OF01EB8PV.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgcttggttttccttgttgcttattttagaaggtgtcagtgtgaggtgcagcgtggtggagtcggtgggggacgccgtggtcaacggccggtcgggggtccctggacgtacctcgtccgtgcgcacgtcccttcgtggtactttccacccgtttcgaacggtaggaaacgggccgtactttaccaacctattcctaccaacgtaacgaaccgaaccgaccaaacggaaccttaccaaccgttggttaacttcgtacgaaacgtaaaacgttaccgtaaaaccaccccgttaggaacggtaccggaccggaaaggaccgtaacgggtcttacggttaagttaacgttttaggtgttacggacggttaagtaacgggtttaaccgaaaccgttaacggttacgggtttttacgggggaccgtaacccgtaaacggtaaacgtaacgtttaaccgttaacgtaaccgtacggacgtacgtacgggtaccgtcggtaccggggaaccaacggaccgaacccggtacgtccgtacccgtctcccgtacctaccgcccgtaccgaccgaaccggtcccgtacgttccggtacccttcccccggtcgacccccgtacccgtacccgtaccgaacgccgtaccgtacccgtggtacccgggg

SEQ ID NO: 273416 - DNA, 843 bp, Homo sapiens
  misc_feature: GYAE6OF01DY9WD.43.79.H02.1.454.CMB.1.raw
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
tcagtgtgagtagtcacgaccggtgctcgatttagtgtcacacgaagggaaaggggcagcttcagctgtggtagagaagacaggattcaggacaatctccagcatggcccgccttccctctccctcctcaccctcctcactcactgtgcagggtcctgggcccagtctgtgctgactcagtccaccctcagcgtccgtcgggacccccggnaggacggtccaccagtccttnttacgttcgtaggaaacnccaagcctaccaaacagtaacggtaaagttaattacttagtaacttagttacggtaaccacgtacgactacccgtaaacccgaaccggtaaacccgtacccccttaaaattccctaactaaccgttacgttaaaacgaaggttaaaaccttaacgtaccggaaacggtccccggtaccccggtaacgggaccgggttaccccgaaggtacccgttcgttaccttacggtcgtacctaacgtaacggtccgtaccggaccctacctacgaacccgtcccttaccgggtactaaccgtaccggtacggtaacggggttcccggaaccggttacccgggtacggaaacggttagccggttaacggtatttacgtaacgtttaacttaccggtgtacggacgtaagaggttaggtaacgggataacggtacctacgggtacgtagggttaccgggttaggtacgggttacgggtttaaccgggtacccgggaaaggggtaacccgtacggtaaaaccgggttacccgtttcccgggaaaaccggtttccggaaacccggtaccctaaccccgggttaacccggacccgtaaccccgg

SEQ ID NO: 273417 - DNA, 777 bp, Homo sapiens
  misc_feature: GYAE6OF01EOSMU.43.79.H02.1.454.CMB.1.raw
  modified_base (215)..(215): a, c, t, g, unknown or other
  misc_feature (215)..(215): n is a, c, g, or t
tcagtgtgagtagtcacgaccggtgctcgatttagtgtcacacgaaagggaaaggggcagcttcagctgtggtagagaagacaggattcaggacaatctcagcatggccgcttccctctcctcctcaccctcctcactcactgtgcgagggtcctcgggccctagtctgtgctgactcacgtccaccctgacgcgtcggtccggggacccccggnacggtacggtccacattcttcttgtcgtaggaactccgagtcctaccaactagtaacggtaaattaattatagtagttagttacgtaccagacaactcctaacccggaaaccggtaaccccggtaacccctaacgttcctacgtaacttacgtaaacgttaagtaacgttaactcgacgggtcccgtacccgttacggggtacccggttcccgtacggaaccggttcttccgtcgtacggtaccctacccggtaacggtccgttcggaccccttccgtaccgtaccgtcccgttcccggtcggtacctaaccttcggtaacgggtccgggtccccggtcggtaaccggacggtagtccggtacgtacgtagtttacttaccgttgtaggtccgcggtaacgtcggaggttagggtaacctgaaccggttcgaccggttgggtacgggtggtttacgggttggtaaccgggttccggggacggggtaacggtaacccgtaggtacccggtaccgaccgggttacctacggtaaccgacccgggtaaccgttccggggtacccc

SEQ ID NO: 273418 - DNA, 665 bp, Homo sapiens
  misc_feature: GYAE6OF01DSOWG.43.79.H02.1.454.CMB.1.raw
  modified_base (477)..(477): a, c, t, g, unknown or other
  misc_feature (477)..(477): n is a, c, g, or t
tcagtgtgagtagtcacgaccggtgctcgatttagtgtcacacgaagggaaagggcagcttcagctgtggtagagaagacaggattcaggacaatctccagcatggccgcttccctctcctcctcaccctcctcactcactgtgcagggtcctgggcccagtctgtgctgactcagtcaccctcagcgtctcgggaccccccgggagagggtcaccagtcttcttgttctggaagcagcctcaacagtacgaagtattatgtaatattggtacagtcagtctaccccaacgaacccggaccccctaaaattcctacattccgtaatacggaataatcagccggtcccctacgacggggttcccaggacccgtatttcctcgtcggctaccaagtcgtcggactacctcaccgtcctaccgtcgccatccgagtcggactccggtccgagactgaggtctagtactttatactggtcncgtacgcgtaggtacgggttacgacggtaacgtaccgtaccggtggttaacggggttgggtttaagggttcccgggtttagggttccgggaaccgggggtaacggggtaccaaaccgggttccggtaccggtaaccccggtttaccgttacgggacccgaacggccccccggtaaagggtcccccggg

SEQ ID NO: 273419 - DNA, 909 bp, Homo sapiens
  misc_feature: GYAE6OF01BZIC5.43.79.H02.1.454.CMB.1.raw
tcagtgtgagtagtcacgaccggtgctcgatttagtgtcacacgaagggaaagggggagagaggagccttagcctggattccaaggcctatccacttggtgatcagcactgagcaccgaggattcaccatggaactggggctccgcttgggttttccttgttgctattttagaaggtgtcagtgtgaggtgcagcgtggtggagtcgtgggggagccgtggtcaaggccggtgggggtccctgagacttctccgtgtcgcacgtccttacgtggtacttcctaccgttacgacggtaggtaaacgggtccgtaacttaccaaccgtattaccctaccgagaaacggaaccaaaccggaaccaaacgtaaccgttaccaagttcgtaacttacctaggaaacctaaaacgtacgaaacccgtaccctaaggaacggaacggtacccgggaaacgggaccgtaccgggtacttacgggttacgttaaagttttacggtacggttaggtaacggtaacgggttaacgtttacgggaaaacccgttacggggttttaacgggtttttaccgggggacccgggtaaaaccccggtaaacgggtaaacgttaacccgtttaacgttaaacccgtttaaccggtaccgggtaacgtaacgggttaccgggtaccggttaccgggttacgggggaaaccctacgggaacccctaaccgggtacccggtaacccgtaccccggttactacccctaaccggtacctaaccccgtacccgaaccccggtaaaccgggtacccccgttaacgttcccccggggttaccccttccccccggtacggaccccccttaacccccgttacccgtaaccccgtaacggtacccgtaacccctcccgggttcgggtaaccccggggg

SEQ ID NO: 273420 - DNA, 914 bp, Homo sapiens
  misc_feature: GYAE6OF01CXWV3.43.79.H02.1.454.CMB.1.raw
  modified_base (118)..(118): a, c, t, g, unknown or other
  misc_feature (118)..(118): n is a, c, g, or t
  modified_base (144)..(144): a, c, t, g, unknown or other
  misc_feature (144)..(144): n is a, c, g, or t
  modified_base (157)..(157): a, c, t, g, unknown or other
  misc_feature (157)..(157): n is a, c, g, or t
tcagtgtgagtagtcacgaccggtgctcgatttagtgtcacacgaagggaaaggggagagaggagcttagccctggattccaaggcctatccacttggtgatcagcactgagcaccgnggattcaccatggaactgggctccgnttggtttctgtgntagtttagagtgtccagtgtgagtgcagcgtggtggagtcggtagggggacgtccgtagactacgaacgggtcccggttaggggggtcccctaggtacgtaccttccgtaccgtggtcgacgacgtccttcgtaggtccttaccgtaccgtacgtaggaggtaaccgggcctacgtactaccctattacccgtacaacgtaacgaaccgaaccgtacgaaaacgtacccgtacctaacgtttagtacctacggtaactaaccgtaaaacggttaccgaaccgtaaccccgtggtaaaccgggacgtaccccggggaaaggacccgtaacgggtcccgttaaggtttaggttaattttaccgttagggttaacccgaacgggttaagggttaacccgtttaaccggaaaacccggttacggttttaccggggttttaccggggaacccggtaaccccgtaaacggtaacgttaacgttttaaccgttaaccgtacgggttaaaccggcgtaacggttaccgggaaccggtgttaacccggggaccggtaaccggtaccgaccccgggtaacccggttacccgtacccgggttcctaacccgtacgaccccggttaacccacccccgggttaaaccgaaccccggggaccctttaaccggtcccccggtttaacccccttcccccggtacccgtaacccccaacccccgttaccccgaaacccgtaaccggtcgtacccccgttccgggtaacccgggg

SEQ ID NO: 273421 - DNA, 787 bp, Homo sapiens
  misc_feature: GYAE6OF01D7XJG.43.79.H02.1.454.CMB.1.raw
  modified_base (210)..(210): a, c, t, g, unknown or other
  misc_feature (210)..(210): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctccaccctcctcactcactgtgcagggtccgtgggcccagtctgtgctgactcagtccaccctcagcgtcgtcgggacccccggnaggaggtccaccatctcttgttcgtggaagcagcctaccaactagtacggtaaagttaattagtagtaattagttggtaacctagacgacgccgtacccgaaaaccggaaccccggtacccccctaaaactttcccgtacaacgttactaaagtaacgggtaacttaaactcccgaacggtacccgggtaccccttacgggaaccgggggtcccctaacgggaacccgtacgttttcgtccgtacgggtaccctaacggtaaccgttccgtcggacccgtaccctccgacggtccccttacccggtcggaccctacgtaccggtacgggttacgggcccttaccccggggtacgtaagggtacgttacgggacgggttcttaacggttacgttttaacgttacgtcggttagaccgtaagccgtaaggtcgggtagtaccggtacgtacgttccgtaaggtcgggttgggttggttacggttacggttcggggaacgggtacccggtaacgtaggtcccggtaacgaccccggttaacgtacgggtacccaaccggtccccggaaggtccccccggg

SEQ ID NO: 273422 - DNA, 920 bp, Homo sapiens
  misc_feature: GYAE6OF01B1OYL.43.79.H02.1.454.CMB.1.raw
  modified_base (170)..(170): a, c, t, g, unknown or other
  misc_feature (170)..(170): n is a, c, g, or t
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (689)..(689): a, c, t, g, unknown or other
  misc_feature (689)..(689): n is a, c, g, or t
tcagtgtgagtagtcacgaccggtgctcgatttagtgtcacacgaagggaaaggggcagcttcagctgtggtagagaagacaggattcaggacaatctcagcatggccgcttccctctcctcctcaccctcctcactcactgtgcgagggtcctcgggcccagtctgtcnctgactcagtccacctnacgcgtccggtaccggggacccccggntacgggacggtccaacctattccgttctttcggttccgaaggaacgccacggtccttaaccgaacgtacggtaacggtaaaagttttaattagttagtaactttaacggtttacgggtaacccaagtccgaacgtaaccccgtaaccccgaaaacgggtaaacccccggtaccccttaaaacttccctacgttaacgttaaccgtaaggttaacgaattaacgtccgacggttcccggtacccgtacgggtacccgggtcctacggtaccgtttattacccgtggtcgtacccttaacgtacgggtactcccggacctaaaccgtccgtaccggtccccctaccggtcggtaaccctacggttaccggtccgggtccggggttacccctaccccggggttacgggaacggtacggttacgggtaccgtagtttaacgttaacccgttttagtttacccgggtagaccggttaacncgggttaaaccgtagggtaccggtaacgttaccgtaccgggtaacgttaccggtgggggttaccgtttagggggtttaaccgggtttacggtaaccgggggtttaacccgggggaaccgggttaaccgggaaaccccggttaaggaccccgggtttaccggtaacccccgggtttaagggtacccggtacccggaacccccgggtaaaccgggtttccgtacccccccggg

SEQ ID NO: 273423 - DNA, 1061 bp, Homo sapiens
  misc_feature: GYAE6OF01D1SSY.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctgggtggagtcggtgggggaggccgtgggtacaacggcccggttcgggggggtcccctggacgtacccgttccttcccgttggtcgaccgacggtcccgttcgtggttaccttacccgtacccgttacgtaaggtacgggtaaccgggtaccgttacgttacccaacctacgtcccgtaaccgaacggaaccgaaccgaaccgaacccgaaaacgtaaccctaccgtaacgttacgttacgttacgtaacgaacctaaacgtaaccgtaaacccgtaacccgtaggaacggaccggaaccggtacgggaaccggtaaccgggtacgtttaggttaaggttttaacgtttacggttacggtacgggtaacggtaaacgggtttaacgggtttaaaccgggtaaacccggtttaaaccgggggttttaccggggttttaccggggggtaacccccgggtaaaaccccgggtaaaacccggttaaaccggtttaaaccgtttaaacccggtttaaacccgttaaccgggttaaccggttaacggtaacggttaccgggtaccgggttaaccggggtaccgggtaacccggtaaccgggtaaccccgtaaccccgggtacccgggttaccccgttaccccgtttaccccgttaccccgtacccgtaccccgtacccccgtaaacccccggtaaaccccgggtaaccccgggttacccccggttacccggtttcccccccgggttaccccccggttttaccccccggtcccccggttaaccccccttaccccccggttaaccccccgttaaaccggtaacccggtaccccggtaaccccgggttaccccggtcccggggggtaaccggg

SEQ ID NO: 273424 - DNA, 387 bp, Homo sapiens
  misc_feature: GYAE6OF02JV9VQ.43.79.H02.1.454.CMB.1.raw
  modified_base (377)..(387): a, c, t, g, unknown or other
  misc_feature (377)..(387): n is a, c, g, or t
tcagtgtgagtagtcacgaccggtgctcgatttagtgtcacacgaagggaaagggccgattcaccatctccagagacaacgccaagaactcactgtatctgcaaatgaacaccctgagagccgaggacacggctgtgtattattgtgcgagagtttgaaccacgatttttggggcggcccaacgaagactattactactacggcatggacgtctgggggcccaaggcaccacggtcaccgtctcctcagcctccaccaagggcccatcggtctcccctgcacctctccagagcacctctggggcacagcggccctgggctgcctggtcaaggactacttccactactcacactgagcgggctggcaaggcgcatagnnnnnnnnnnn

SEQ ID NO: 273425 - DNA, 504 bp, Homo sapiens
  misc_feature: GYAE6OF02G3AAL.43.79.H02.1.454.CMB.1.raw
  modified_base (205)..(205): a, c, t, g, unknown or other
  misc_feature (205)..(205): n is a, c, g, or t
  modified_base (441)..(441): a, c, t, g, unknown or other
  misc_feature (441)..(441): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctgggacccccggnagagggtcaccatctcttgtctggaagcagctccaacatcggaagtaattatgtatattggtaccagcagctcccaagaacggcccccaaattcctcatctataggaataatcagcggccctcaggggtccctgaccgattctctggctccaagtctggcacctcagcctccctggccatcagtgggctccggtccgaggatgaggctgattattactgtgcagcatgggatgacngcctgagtggtgtggtattcgggcggaggaccaagctgaccgtcgtaggtcagcccaggtccg

SEQ ID NO: 273426 - DNA, 497 bp, Homo sapiens
  misc_feature: GYAE6OF02IRX23.43.79.H02.1.454.CMB.1.raw
  modified_base (205)..(205): a, c, t, g, unknown or other
  misc_feature (205)..(205): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (459)..(459): a, c, t, g, unknown or other
  misc_feature (459)..(459): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctgggacccccggnagagggtcaccatctcttgttctggaagcagctccaacatcggaagtaattatgtatattggtaccagcagctcccaagaacggcccccaaattcctcatctataggaataatcagcgcctcagggtccctgaccgattctctggctcagtctggcactcagccctcctggccatcagtcggctccggtccgaggatggaggctgtattattactgtgcngcatgggatgacngcctgagtgtgtgtattcggnggacggacaagctgaccgtcgtaggcacgccaggtccg

SEQ ID NO: 273427 - DNA, 564 bp, Homo sapiens
  misc_feature: GYAE6OF02GV0H7.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagcctggggggtccctgagactctcctgtgcagcctctggattcaccttcagtgaagggccgattcaccatctccagagacaacgccaagaactcactgtatctgcaaatgaaccaccctgacgagccgaggacacggctgtgtattatgtgcgagagttgaccacgtagttttggggcggcccaacgaacgactattactactacggcagtggacgtcgtgggccaaggcaccgacggtcaccgtctcctcacgccctccaccgacgggcccacgtccggtacccttccccgtcggccctacccctccctaccgaacgacgacctaccgtccgtcgggg

SEQ ID NO: 273428 - DNA, 717 bp, Homo sapiens
  misc_feature: GYAE6OF02HX3RY.43.79.H02.1.454.CMB.1.raw
  modified_base (185)..(185): a, c, t, g, unknown or other
  misc_feature (185)..(185): n is a, c, g, or t
  modified_base (232)..(232): a, c, t, g, unknown or other
  misc_feature (232)..(232): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcacctcctcactcactgtgcagggtcctgggcccagtctgtgctgactcagtcaccctnagcgtctgggacccccgggcagagggtcaccatctcttgtctggaancagctccaacatcggaataattatgtatattggtaccagcagcctacccgaaagaaccggaccccctaaattccctacattactaagtaaggaaattaaactcgacggaccggtcccctacgacgggggtcccctaggaaccgtatttacctcgtcggctaccgtaagtctcggaccacctcacgtccctcccgtcggacctactcgacgggttcgggtcccgtcccgggttcccggaagggtacgttcgggaggtccgttaggtaacgttttaacttttaaccggtgttcgtaccgtaacggtaccgtaaggttagggggaattacggaaccgacggtccgttaggaagggtttcgggttgggttacgggtttacggtttccggggacgggggtaaccggggtaaccaacgggtccgttacgggtaaccccgggttcccgttaacggggtacccgaaccggtaccccggtaaagggtcccccgg

SEQ ID NO: 273429 - DNA, 549 bp, Homo sapiens
  misc_feature: GYAE6OF02GWR4E.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtgaagggccgattcaccatctccagagacaacgccaagaactcactgtatctgcaaatgaacacctgagagccgaggacacggctgtgtattattgtgcgagagttgaaccacgtagttttggggcggccgaacgaagactattactactacgcatggacgtcgtgggcaaggcaccgacggtcaccgtctcctcacgcctccaccgacggcccacgtccggtccttcccccgtcgtcccaccctccctccaacgacgccacccgtcgtcgggg

SEQ ID NO: 273430 - DNA, 545 bp, Homo sapiens
  misc_feature: GYAE6OF02GJ2JT.43.79.H02.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (457)..(457): a, c, t, g, unknown or other
  misc_feature (457)..(457): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctnagcgtctgggacccccgggnagagggtcaccatctcttgttctggaagcagctccaacatcggaagtaattatgtatattggtaccagcagctcccaagacggccccaaattcctacatctataggaataatcagcgccctcgaggggtccctgaccgattctctggctccaagtctaggccacctcacgccctcctcggccatcagtcgggctccggtccgaggatggaggctgattattactgtgcagcagtgggatggacagcctagngtggtggtggttagttcggggcgggtaacgggaccgaaggccgttaggtacccggttccgtagggtaccacggaccccgaaggtcccg

SEQ ID NO: 273431 - DNA, 559 bp, Homo sapiens
  misc_feature: GYAE6OF02GCPZQ.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtgaagggccgattcaccatctccagagacaacgccaagaactcactgtatctgcaaatgaacaccctgagagccgaggacacggctgtgtattattgtgcgagagttgaaccacgtattttggggcggcccgaacgaagactatactactacggcatgacgtcgtgggccaaggcaccacggtcaccgtctcctcacgcctccaccgacggcccacgtccggtccttcccccgtcggtcccaccccgtccctacccgaacgacgccctacccgtcgtaccgggg

SEQ ID NO: 273432 - DNA, 537 bp, Homo sapiens
  misc_feature: GYAE6OF02GYGEV.43.79.H02.1.454.CMB.1.raw
  modified_base (207)..(207): a, c, t, g, unknown or other
  misc_feature (207)..(207): n is a, c, g, or t
  modified_base (471)..(471): a, c, t, g, unknown or other
  misc_feature (471)..(471): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctcgggacccccgggnagagggtcaccatctcttgtctggaagcagctccaacatcggaagtaattatgtatattggtaccagcagctacccaagaaccggcccccaaattcctcatctataggaataatcagccggcctcgacggggtccctgaccgtattctctcggcctccaagtctggccacctcacgccctcccgtcggcctatcgaggtcgggcctcccgggtccgagggatggaggtcttagtatttattacgtgtgacagcagtggatgacngccgtgagtggtgtggtagtcgggcggacggacagcgtacgaccgtcgaggtcacgccgagtcccg

SEQ ID NO: 273433 - DNA, 566 bp, Homo sapiens
  misc_feature: GYAE6OF02FG23D.43.79.H02.1.454.CMB.1.raw
  modified_base (326)..(326): a, c, t, g, unknown or other
  misc_feature (326)..(326): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagcctggggggtcccctgagactctcctgtgcagcctctggattcaccttcagtgaagggccgattcaccatctccagagacaacgcaagaactcactgtanctgcaaatgaacaccctgacgagccgaggacacggctgtgtattattgtgcgagagttcgaaccacgagtttttggggacggcccgaacggaagacttattactactacggcagtggacgtcgtgggccgaaggccaccgacggtccaccgtcctacctcacgcctccaccgacggcccacgtccggtcccttccccctcggcctaccctcctacccgaacgacgccaccgtcgtcgggg

SEQ ID NO: 273434 - DNA, 556 bp, Homo sapiens
  misc_feature: GYAE6OF02FMXCH.43.79.H02.1.454.CMB.1.raw
  modified_base (468)..(468): a, c, t, g, unknown or other
  misc_feature (468)..(468): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaccttcagtgaagggccgattcaccatctccagagacaacgccaagaactcactgtatctgcaaatgaacaccctgagagccgaggacacggctgtgtattattgtgcgagagttgacacgtattttggggcggcccaacgaagactattactactacggcatggacgtctgggccaggcaccgacggtcaccgtctccncacgcctaccaccgacgggcccacgtccggtccctttcccccgtcgtcccacccctccctcccaacgacgccaccctcgtaccggggg

SEQ ID NO: 273435 - DNA, 566 bp, Homo sapiens
  misc_feature: GYAE6OF02H7KKA.43.79.H02.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctnagcgtctcgggaccccggnagagggtcaccatctcttgtctggaancagctcaacatcgaagtaattatgtatattggtaccagcagctccaagaacggcccccaaattcctcatctatagaataatcagcggccctcgaggggtccctgaccgacttctctggctccgaagtctaggccaccttcacggcctaccccgtcgggtccactccaaggttcggggccttcccgggtaccggacgggtattcggaaggccttggaactttattacgtgtagcagccgaagtcgggattcgaactcggcctggagtggtggttggtaagttcgggcgggacggacgaacggctgaccgtccgtaggtccaagcccgaagtcccg

SEQ ID NO: 273436 - DNA, 604 bp, Homo sapiens
  misc_feature: GYAE6OF02JSU73.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaccttcagtgaagggccgattcacctatctcagacgacaacgccaaagaactcactgtatctgacaaatgaaccacctgagacgccgaaggacacggctgtatattattggtgcgagtagttacgaactacgtagttttcggggccggtacccgaaacggaacgtaacttaacttaaccgtactaacggctagtaggacgtcgtcgggaccgacggaccgaccgacggtaccaccgtcctcctcacgccctaccgaccgaccggacccacgtccggtccttccccgtccgaccctacccgtccctaccgaccgacgaccgtaccctcggtaccggg

SEQ ID NO: 273437 - DNA, 566 bp, Homo sapiens
  misc_feature: GYAE6OF02GB8DN.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtgaagggccgattcaccatctccagagacaacgccaagaactcactgtatctgcaaatgaaccacctgagagccgaggacacggctgtgtattattgtgcgagagttgaaccgtacgtagttttggggcggacccgaacgaagactattactactacgcatggacgtcgtgggaccgaaggcaccgacggtccaccgtctccctcacgcctaccgaccacggcccacgtccggtcccttccccgtcggcccacccctcctacccgaacgcgacctacccgtcgtaccgggg

SEQ ID NO: 273438 - DNA, 585 bp, Homo sapiens
  misc_feature: GYAE6OF02FZM04.43.79.H02.1.454.CMB.1.raw
  modified_base (503)..(503): a, c, t, g, unknown or other
  misc_feature (503)..(503): n is a, c, g, or t
  modified_base (550)..(550): a, c, t, g, unknown or other
  misc_feature (550)..(550): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcatcatggaactggggctccgctgggttttccttgttgctattttagaaggtgtccagtgtgaggtgcagctggtggagtcgtgggggaggcctggtcaaggccgtggggggtccctgagactctcctgtgcagcctctggattccaccttcagtgaagggccgattcaccatcctccagagacaacgccaaagaactcactgtatctgcaaatgaacaccctgagagccgaggacacggctgtagtattattggtgcgagtagttgaacctacgtagttttggggcggtacccaaacgaagactaatactaactacggcagtggacgtcgtcgggaccgaacggacacccgacggtccaccgtcctcctcacgcccncccaccgaacgggccctacgtccggttcccttcccccgtcggacccnccccttccctacccgaacgccgaccaccctccggg

SEQ ID NO: 273439 - DNA, 573 bp, Homo sapiens
  misc_feature: GYAE6OF02GZH7V.43.79.H02.1.454.CMB.1.raw
  modified_base (304)..(304): a, c, t, g, unknown or other
  misc_feature (304)..(304): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (529)..(529): a, c, t, g, unknown or other
  misc_feature (529)..(529): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggggaggcctggtcaagccgtggggggtccctgagactctcctgtgcagcctctggattcaccttcagtgaagggccgattcaccatctccaganacaacgccaagaactcactgtatctgcaaatgaaccacctgacgacgccgaggacgacggctggtgtattattgtgacgagagttacgaaccacgtagttttgggcggccaaacgagactattactactacggcagtggacgtcgtgggccaaggcaccgcgtcaccgtcncctcncgcctccgaccacgggcccacgttccggtccttcccccgtcggtacccncccgttccctacccgaagccgaccgtacccgtcggtacccgggg

SEQ ID NO: 273440 - DNA, 591 bp, Homo sapiens
  misc_feature: GYAE6OF02IMEDF.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtgaagggccgattcaccatctccagagacaacgccaagaactcactgtatctgacaaatgaacaccctgagagccgaggacacggctgtgtattattgtgcgagtagttagaaccacgtagttttggggcggacccgaacgaagactaattactactacggcatggacgtcgtcgggaccgaaggccgaaccgaccggtaccacccgtcctccctccgacgccctacccgaaccgacgggacccacgtcccggttcccttcccccgtcggcccaccccgttccctacccgaacgaccgccacccgtcggtccgggg

SEQ ID NO: 273441 - DNA, 642 bp, Homo sapiens
  misc_feature: GYAE6OF02FYZWI.43.79.H02.1.454.CMB.1.raw
  modified_base (327)..(327): a, c, t, g, unknown or other
  misc_feature (327)..(327): n is a, c, g, or t
tcagtgtgagtagtcacgaccggtgctcgatttagtgtcacacgaagggaaagggggagagaggagccttagccctggattccaaggcctatccacttggtgatcagcactgagcgaccgaggattcgaccatggaactggggctccgctgggttttccttgttgcttattttagaaggtgtccagtgtgaggtgcagctggtggagtctgggggagcctggtcaagccgtggggggtccctgagactctcctgtgcagcctctggattcaccttcgagtgaaggccgtattcaccatctcagagacaacgcaagaactcactgtanctgcaaatgaaccacctgacgagccgaaggacacggctgtagtattatgtgcgagagttacgaactacgtagttttcgggcggacccgaaacgaacgaacgttaattactaacgttacgactagtcggtacggtcgtcggggacctaacggaccgaacccgtacggtacccgtaaccgttcccgtacccttaccgacgccccgtacccacccgaacgggccccgacggttcccggttcccgtttacccccggtaccggtcccctaccccgtcccgttaccgaaaccgtaccgaccgtacccgtcggtacccgggg

SEQ ID NO: 273442 - DNA, 749 bp, Homo sapiens
  misc_feature: GYAE6OF02J0979.43.79.H02.1.454.CMB.1.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtcgtcgggacccccggnaggaggtcaccatcctcttgtctggancagctccaacatcggaagttaattatgtattattggtaccagcagtcctacccaaagaaccccggccccctaaattccctactaactaccttaagtaaggtaaataactcgacgccggacccttacggaacggggttcccctaggaacccgtactttccgtcgttcgggtccctacgtaaacggttccgtcgggacctacccgtccgaccgtccccgttcccgtacggccctaacgtccgtacgggttcgggcccgttcccgggtaccggacgggtacgtacggtcggtaccgttagttaagtttacgttaccgttggtaccgaccgtacgccggttaaggttacgggacttacggaaccgtacggtccggttaggtaaggggttcgggtttagggttccgggttaaggtttacccggggacggggtaacgggtaacccgtaaggtaccgttaccgggtaccccgttaccgggttacggtaacccggtaccgggaccccggtaagggtcccccgg

SEQ ID NO: 273443 - DNA, 555 bp, Homo sapiens
  misc_feature: GYAE6OF02HMRMJ.43.79.H02.1.454.CMB.1.raw
  modified_base (207)..(207): a, c, t, g, unknown or other
  misc_feature (207)..(207): n is a, c, g, or t
  modified_base (482)..(482): a, c, t, g, unknown or other
  misc_feature (482)..(482): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctcgggacccccgggnagagggtcaccatctcttgttctggaagcagctaccaacatcggaagtaattatgtatattggtaccagcagctacccaagaaccggacccccaaattcctacatctatagaataatcagcgccctcgacggggtccctgaccgtattctctcggctaccaagtctggcctacctcacgccctcccgtggccactcgaggtcggccgtcccgggtcggaggacgtggacggtcttaggtaattacgttacgtgtcgcagcgtagtgggatgacgngcgtgagtggtgtggtagttcgggcggaggaccagtcgtacggaccgtcgtagtccgacgtacccgaggtccg

SEQ ID NO: 273444 - DNA, 572 bp, Homo sapiens
  misc_feature: GYAE6OF02IOWXC.43.79.H02.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (487)..(487): a, c, t, g, unknown or other
  misc_feature (487)..(487): n is a, c, g, or t
  modified_base (513)..(513): a, c, t, g, unknown or other
  misc_feature (513)..(513): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcaggtcctgggcccagtctgtgctgactcagtcaccctcagcgtctcgggacccccggnaggagggtccaccatctcgttgttcnggaagcagcctcaacntcggaagtaattatgtatattggtaccagcagctacccaagaaccggccccaaattcctcatctataaggaataactcacgccgccctcgacggggtccctgaccgtattcctctcggtcctaccgaacgttcgtacggcctacctcgacgccctaccgtcggccctagtcgacggttcgggcccttcccgggtccgaggtactggacgtcttagtattacttacgtgtcgcgagctagnggtatcgactcgcgtgaggtggttgnggttacgtcgggaggacggacaagtcgacgtaccgtcgtacggtcgacgccgagtcccg

SEQ ID NO: 273445 - DNA, 393 bp, Homo sapiens
  misc_feature: GYAE6OF02HLF7L.43.79.H02.1.454.CMB.1.raw
  modified_base (383)..(393): a, c, t, g, unknown or other
  misc_feature (383)..(393): n is a, c, g, or t
tcagtgtgagtagtcacgaccggtgctcgatttagtgtcacacgaagggaaagggccgattcaccatctccagagacaacgccaagaactcactgtatctgcaaatgaacaccctgagagccgaggacacggctgtgtattattgtgcgagagttgaaccacgatttttggggcggcccaacgaagactattactactacggcatggacgtctggggccaaggcaccacggtcaccgtctcctcagcctccaccaagggcccatcggtcttcccccctggccaccctcctccaacgagcacctctggggcacagccggccctgggctgcctggtcaaggactactccactactcacactgagcgggctggcaaggcgcatagnnnnnnnnnnn

SEQ ID NO: 273446 - DNA, 589 bp, Homo sapiens
  misc_feature: GYAE6OF02JGSMB.43.79.H02.1.454.CMB.1.raw
  modified_base (378)..(378): a, c, t, g, unknown or other
  misc_feature (378)..(378): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgtgcagcctctggattcaccttcagtgaagggccgattcaccatctccagagacaacgccaagactcactgtatctgacaaatgaaccaccctgacgacgccgaggacacggctgtgtattattggngcgagtagttacgaacctacgtagttttcggggccggaccgaaacgaagtactattactacgtacggacagtggtacgtcgtcgggaccgaaggacgaccgacgtccgtaccgtctcctcacgcctccacccgacgggccctacgtccggttcccttccccgtcgtccctacccctcccgtacccgaacgacgaccgtacctcggtacggg

SEQ ID NO: 273447 - DNA, 558 bp, Homo sapiens
  misc_feature: GYAE6OF02FJZAW.43.79.H02.1.454.CMB.1.raw
  modified_base (302)..(302): a, c, t, g, unknown or other
  misc_feature (302)..(302): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtgaagggccgattcaccatctccaganacaacgccaagaactcactgtatctgcaaatgaacaccctgagagccgaggacacggctgtgtattattgtgcgagagttgaacctacgagtttttggggcggtcccgaacgaagaactaattaactactacggcagtggacgtctgggccaaggcaccgacgtcaccgtctcctcacgcctccaccacgggcccagtccggtccttccccgtcggcctacccgtccctaccaacgacgccgaccgtcgtacgggg

SEQ ID NO: 273448 - DNA, 642 bp, Homo sapiens
  misc_feature: GYAE6OF02FN6P9.43.79.H02.1.454.CMB.1.raw
  modified_base (405)..(405): a, c, t, g, unknown or other
  misc_feature (405)..(405): n is a, c, g, or t
tcagtgtgagtagtcacgaccggtgctcgattttagtgtcacacgaagggaaagggggggaggagaggagcccttagccctggattccaaggcctatccacttggtgactcagcactgagcaccgaggattcaccatggaactggggctccgctgggttttccttgttgctattttagaaggtgtccagtgtgaggtgcagctggtggagtcgtgggggaggcctgggtcaaggccgtggggggtccctgacgacgtcctcctggtgcagcctcgtggattcaccttcagtgaagggccgattcaccatctcagagacacgccaagactcgacgtgtatctgacaaagtgaaccaccgtggacgacgaccggaaggaccgacgggctaggtagtatttagttggngacggtagtaggttacgaaccgtacggtacggtttttcgggggaccggtacccgaaacggtaaacggtaacgttacgttaacctaccgtacggcagtacgggtacgtcggtcgggacgaacggcgaccgacgtcgtaccgtcgtccgtcgacgcctaccgaccgacggccctacgtcggttccttccccgtcgcccgtacccgtccgtaccgtacgaccgccgtaccgtcggtcggg

SEQ ID NO: 273449 - DNA, 660 bp, Homo sapiens
  misc_feature: GYAE6OF02IE5UB.43.79.H02.1.454.CMB.1.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (388)..(388): a, c, t, g, unknown or other
  misc_feature (388)..(388): n is a, c, g, or t
  modified_base (569)..(569): a, c, t, g, unknown or other
  misc_feature (569)..(569): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcacctcactgtgcagggtcctgggcccagtctgtgctgactcagtccaccctnagccgtcgtcgggaccccggnacggacggtcactntctcttgtcgtggaagcagcctacaacgagtacggtaaagttaattagtgtaattagttacggacagtcacgcctaccgaaacgaaccgacccctaaattccacacttactacgtaagaataactacgacgccgtccctacggtacgggtaccctacggaacctnttcctcgtcgtacctaccgtaacgtccgtcggaccctaacctcgaccgtccctcccgtgaccacgtcgtagggtccggtacccgtccggtaccggaaggtctacgggtacggacttagtaacgtttataccgttggacaccgtaagtcgtaggtcgggtaatcggacgtacgtaccgtagnggttacggtgttacgggtgttacgggcgggaaccggtacaagtccgcggttacctaaccgggttcgacgtaccggtaccgacggttccccg

SEQ ID NO: 273450 - DNA, 748 bp, Homo sapiens
  misc_feature: GYAE6OF02GYHUH.43.79.H02.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtccaccctnagcgtcgtcgggacccccggnaggaggtcaccatctcttgttcaggaancagcctacaacatacggaagtaagttatgtaattagttaggtaccaganagcctaccaaagaacccgaccccaaacttcctacactactaataagaataatcgacgaccgccgttacgacgggtccctacggaccgtattaccgtcgtacggttacctaccccgtaaagttccgtacgggtacctaacccgttaccgaacggttccccctttaccccggtacgggtaccctaacgttaccggtaacggggttaccggggtacccggtttaccccggggtacccgggaaacgggtaacgttacgggtaaacggtccgttaagtacgtttttaacttaccgtttaggtaccgtacgtaacgtcggaaggttacggggtacttaacgaccggtacgtcccggttagtagggttacgggtgttagggttaacggttcggggacgggtaacgggaccgtaacggtccgtacggtaccgggttcgtacggtaaccggaccggtacccgacggttcccg

SEQ ID NO: 273451 - DNA, 595 bp, Homo sapiens
  misc_feature: GYAE6OF02HEINL.43.79.H02.1.454.CMB.1.raw
  modified_base (382)..(382): a, c, t, g, unknown or other
  misc_feature (382)..(382): n is a, c, g, or t
  modified_base (504)..(504): a, c, t, g, unknown or other
  misc_feature (504)..(504): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgtgcagcctctggattcaccttcagtgaagggccattccaccatctccagagacaacgccaagaactcactgtatctgacaaatcgaaccacctgagacgaccggagacgacggtctaggtcgtaattnttagtgcggtaagtacgttagaaccgtacgtagttttcggggaccgtaccgaacgaaagtactaattaactacgtaacggtcagtggacgtcgtcgggacgacgccacgcgtccaccgtccnccgtcacgccctaccgaccgacggtacccacgtccggtcccttccccgcgtaccctacccgtccctcgaacgacacctaccgtcgtacggg

SEQ ID NO: 273452 - DNA, 627 bp, Homo sapiens
  misc_feature: GYAE6OF02G8AX0.43.79.H02.1.454.CMB.1.raw
  modified_base (248)..(248): a, c, t, g, unknown or other
  misc_feature (248)..(248): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctcggggacccccggcaggacgggtcaccatctcttgttctggaagcagctaccaanatcggaagtaattatgtatattggtaccagcagctccaagaccggaccccaaattcctcatctatagaataatcagcgcctcgacgggtcctgaccgtattctctcggctccaagtctggcacccttcacgtccctcccgtcggcctatcgaggttcgggtccgttcccgggtccggaagggactacggaggtcgtagttaatttacgttaccgtgttcgacgtacgcgtaaggtcgggagtcggaaccgtacgtccgttgggtacggttgggttaggttacgggttacggttccggggacggggtaaccgggaaccgaaggttccgtaaccggtacccggttaccgtaacggtccgaccggtacccgaacggtccccg

SEQ ID NO: 273453 - DNA, 527 bp, Homo sapiens
  misc_feature: GYAE6OF02FPR2W.43.79.H02.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (427)..(427): a, c, t, g, unknown or other
  misc_feature (427)..(427): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctnagcgtctgggacccccggnagagggtcaccatctcttgtctggaagcagctaccaacatcggaagtattatgtatattggtaccagcagctcccaagaccggccccaaattccncatctataggaataatcagcggccctgacgggtcccngaccgattctctggctaccaagtctggccacctcacgccctcctggccatcagtggcctccggcgagatgaggtctgatttattactgtncagcagtggatgacagcctgagttggtgtggtacgttcgggcggtagggaccaaggtccgtaggtacccgttccgtaggtaccacggtcccgaaggtccc

SEQ ID NO: 273454 - DNA, 571 bp, Homo sapiens
  misc_feature: GYAE6OF02FIY8Z.43.79.H02.1.454.CMB.1.raw
  modified_base (333)..(333): a, c, t, g, unknown or other
  misc_feature (333)..(333): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggatcaccatggaactggggctccgctgggttttccttgttgctattttagaaggtgtccagtgtgaggtgcagctggtggagtcgtgggggaggcctggtcaagcccgtggggggtccctggagactctcctgtgcagcctctggattcacctttcagtgaagggtccgattcaccatcctccagagacaacgccaagaactcactgtatcngcaaatgaacaccctgagagccgaggacacgggctggtgtaattattggtgcgtagagttgaaccacgtagtttttggggcggtcccaacgaacgactaattaactactacggcatcggacgtcgtgggccaaggcaccgcggtcaccgtcctccgtcacgcctaccaccgacgggcccacgtccggtccttcccccgtggccaccccgtccctccaacgcgctaccctcgtacgggg

SEQ ID NO: 273455 - DNA, 566 bp, Homo sapiens
  misc_feature: GYAE6OF02GSVN1.43.79.H02.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (404)..(404): a, c, t, g, unknown or other
  misc_feature (404)..(404): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctnagcgtctgggacccccggnaggagggtcaccatctcttgtcnggaancagctcaantcgaagtattatgtatattggtaccagcagctaccaagaaccggccccaaattcctcatctatagaataatcagcgcctcgaggggtccctgaccgtattctctggcctccgaagtctggccacctcacgccctccgtgccatcagtcggctccggtcgagngtggagctgtattagtactggtcactacgacagtgggactgacgtagccgtgaggttcggtgttcgggttacgttccggggaccgggtaagggtacccgtaacggtccgtacggtacccgttaccggtagggtacccgacggttaccccggaaggtccccgg

SEQ ID NO: 273456 - DNA, 572 bp, Homo sapiens
  misc_feature: GYAE6OF02IZG6P.43.79.H02.1.454.CMB.1.raw
  modified_base (440)..(440): a, c, t, g, unknown or other
  misc_feature (440)..(440): n is a, c, g, or t
  modified_base (495)..(495): a, c, t, g, unknown or other
  misc_feature (495)..(495): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcggcctcgtggattcaccttcagtgaaggccgattcaccatctccagagacaacgccaaagaactcaactgtatctgacaaatcgaaacaccctgaacgagccggaaggaccaacggctgacgttaattattggtgacgaagtgtttacgaacgtacgtagttttggggacgtacccgaaacgaanactattaactacctacggacagtgacgtcgtcgggacaagcacacgcacgtctcncacgcctcacaccgccacgtccgtccttcccctcggccaccctacctaccaacgaccgacctaccgtcgtgggaccg

SEQ ID NO: 273457 - DNA, 655 bp, Homo sapiens
  misc_feature: GYAE6OF02F23QN.43.79.H02.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (312)..(312): a, c, t, g, unknown or other
  misc_feature (312)..(312): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctnagcgtctcgggacccccggnagagggtcaccatctcttgttctgggaancagctccaacntcggaagtaattatgtatattggtaccagcagctcccaagaaccggccccaaattcctcgatctanaggaataatcagcggccctcgacgggtccctggaccgtattctctggcctacagtcgtggccacctcacgcccttacccgttgggaccctatccgtacgggtcgggtaccgttcccggggtccggagggtactggaaccgggtcgttagggaattttaacggttacgtcggtggtccaagtccgtaaggtggggtaactcggaaccgttcgggcccgttaggaaggttggggttacgggtttgggttaacgttccgggggacgggtaacggggaacctaacgggtcgttaccggtaccgttaccggttacggacggtaaccggaccccggtaacggtccccgg

SEQ ID NO: 273458 - DNA, 679 bp, Homo sapiens
  misc_feature: GYAE6OF02H6FPD.43.79.H02.1.454.CMB.1.raw
  modified_base (233)..(233): a, c, t, g, unknown or other
  misc_feature (233)..(233): n is a, c, g, or t
  modified_base (350)..(350): a, c, t, g, unknown or other
  misc_feature (350)..(350): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcacctcctcactcactgtgcagggtcctgggcccagtctgtgctgactcagtcaccctcagcgtcgtcgggaccccggcagaggtcaccatctcttgttctggaacncagctaccaacagtcggaagtaacttatgtatagttggtaaccagcagcctacccgaaagaaccggaccccctaaattcctcatctatagaataatcagccggcctcgacgggtccngaccgtattctcgtgcctaccaagttcgcggaccacctcgacgtccctccccgttggaccctactcgtaacgggttcgggcccttcccgggtaccggaaggtacgtcggacggttccttagggttaacttttacgtttaacgttgggtcgaccgtaggtacccgtaagggttacggggacttacggaaccgtacggttccgtagggttacgttggggtttgtacgggtttagttccgggggacggggtaacggacccgtaaggtcccgttcggtaacccggttccggtaaccgggtaccgaacccggtacccgtaaggttccccccggg

SEQ ID NO: 273459 - DNA, 599 bp, Homo sapiens
  misc_feature: GYAE6OF02H5GGI.43.79.H02.1.454.CMB.1.raw
  modified_base (346)..(346): a, c, t, g, unknown or other
  misc_feature (346)..(346): n is a, c, g, or t
  modified_base (402)..(402): a, c, t, g, unknown or other
  misc_feature (402)..(402): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagtgtgagtagtcacgaccggtgctcgatttagtgtcacacgaaagggaaagggggagagaggagccttagccctggattccaaggcctatccacttggtgatcagcactgagcaccgaggattcaccatggactggggctccgctgggttttccttgttgctattttagaaggtgtccagtgtgaggtgcagctggtggagtcgtggggggaggccgtggtcaaggccgtggggggtcccctggagactctcctgtgcagcctcgtggattccacctttcagtggaacgggccgattccaccatcctaccagacgacaacgccaagaacctcgactgtatctnactaaatcgaaccacctggacgacggccggaggaacacggctgtagtattatgtgngagtagtacgacgtacgtgttttgggcgtacccgaagacgactattactacgtacgcagtggacgtcgtgggacctaggaccaccgacgtccgccgtcctcnccgacncctccaaccgaccggcccaggttcccgtcccttccccgtcgtaccctacccgtccctaccgaacgtaccgccgtaccgtcggtaccggg

SEQ ID NO: 273460 - DNA, 724 bp, Homo sapiens
  misc_feature: GYAE6OF02F75E7.43.79.H02.1.454.CMB.1.raw
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
  modified_base (471)..(471): a, c, t, g, unknown or other
  misc_feature (471)..(471): n is a, c, g, or t
  modified_base (602)..(602): a, c, t, g, unknown or other
  misc_feature (602)..(602): n is a, c, g, or t
  modified_base (628)..(628): a, c, t, g, unknown or other
  misc_feature (628)..(628): n is a, c, g, or t
tcagtgtgagtagtcacgaccggtgctcgatttagtgtcacacgaagggaaaggggcagcttcgagctgtggtagagaagacaggagttcaggacaatctcagcgatggccggcttccctctcctcctcctaccctcctcactcactgtcgcgtacgggtccgtcgggacccagtccgtgtcgtctacgacgtcacgtccaccctncgcgtccgtcgggaccccggntacggacgggtccaaccacgttcctcgtttcgttcgtacggaagccgtacggtccaacccgaagntacgggtaaagttaacgttatacggttaacttaggtttacggttaaccaggtaccgacaccgttacccaaacggacccggaacccctaaacctttcccgtactaacttacttaacgtaaggttaaactacgtactaacggtccgtcctacggtaacggtcccgtaggaccctatccgtntccggctaccgtacgtcgtaccgtcaacccgttcgaccgtcccttaccgcggtctaacgccgtagtccgggtcgtccggtacggagtcgtacggacgtcgtacgttacgttagttaaccgtggtactccgngaccgtgtggtaacgttcgaacgttntaccggttggtagttcgtcggtagttacggttcgggacgtacggaacctgggtacttaccgggcttacggaccgtacgccgtacggacgtacccgg

SEQ ID NO: 273461 - DNA, 818 bp, Homo sapiens
  misc_feature: GYAE6OF02J04TY.43.79.H02.1.454.CMB.1.raw
  modified_base (211)..(211): a, c, t, g, unknown or other
  misc_feature (211)..(211): n is a, c, g, or t
  modified_base (378)..(378): a, c, t, g, unknown or other
  misc_feature (378)..(378): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtccacctcagccgtcgtaccggggacccccggnaggacgggtccaccgattcgtccgtttgttcgtaggaacgcagtcctaccgaactagtaccggtaagtaacttatagtaattagttacggtacacgtcacgtacctaccgaacgaccgaccccgaacttacctacctatactacgtaacggtaataacgtcgaccgnggtacccccccccccgtaggtaccgggtacccgtacggtacccgtacgttcgtccgtacggtaccgtacctaacgtcgtacggtacctaccctacgaccgtcccgtacccgtccggtaccgtaccgtacgtacggtccggggtaccgtcccgggttaccggtaacgggtacggtacggtacggtcgttaagttaacgtttacgttaccgttcggtacgtaccgtacggtacgtacggtacgggtacgtaaccggtaccggttaacgtccggttaacgggttacgggttacgggttagggttacgggtttacgggttacccgggggtaaccggggtaaccggggttaaacccgggtaaccggttaccggttacccgggttacccgggttaccggtacccgggtttaaccggaaccggtacccggtaccggttaacccccgg

SEQ ID NO: 273462 - DNA, 594 bp, Homo sapiens
  misc_feature: GYAE6OF02GCPEY.43.79.H02.1.454.CMB.1.raw
tcagtgtgagtagtcacgaccggtgctcgatttagtgtcacacgaagggaaagggggaggaggaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaaccttgagtgaagggccgattcaccatctccagagacaacgcaagaactcactgtatctgacaaatcgaaccacccgtgacgagtccggaggacgacggctgtgtattatgtgcgagtagttcgaacctacgtagttttggggcgaccgaacgaagacttattacgtactacggcagtggacgtcgtcgggacctaaggccaccacggtaccaccgtccgtacctcgacgcctacccgaccgacgggacccacgttccggtccgttcccccgtggtccctacccgtccctaccgaacggcgaccctaccgtccgtaccggggg

SEQ ID NO: 273463 - DNA, 842 bp, Homo sapiens
  misc_feature: GYAE6OF02JKBB6.43.79.H02.1.454.CMB.1.raw
  modified_base (146)..(146): a, c, t, g, unknown or other
  misc_feature (146)..(146): n is a, c, g, or t
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
tcagtgtgagtagtcacgaccggtgctcgatttagtgtcacacgaagggaaaggggcagcttcagctgtggtagagaagacaggattcaggacaatctccagcatgccggcttccctctcctcctcaccctcctcactcactgtcncagggtcctgggcccagtcctgtgctgactcagtcaccctcagcgtcncgggaccccggtnagnggtccacctatcttcgttgttcgtcggaactcacgccttaccaactaacgtacgggtaacgttaaattgtggttaatttacgttacggttacagaccgagtccttaaccccgaaaacgaaccccggtaccccctaaaatttcccgttacgtactacgttaaagtaacgggtaaaacttaaacgttccgaaccggtccgggtacccccttacggggtaacccggggttccccttacggtaacccggttaacttccccgtttacggttacgggacctttacccgaacggtttccgttacgggtaaccctccccgttaacgaacccgtccctttaccccgggtagggtaccctacggtttcccgaacggggttttccgggaccctttaccccgggtcgggtaacgtacgtttgggaaccggggtactttacggttaatttaaccgttacggttcgttaacggcccttagcggttaacgtgggtaaccttgggaaacccgtcgttacgtaacggttggggttacgggtggtttaccggtacgggttcgggtacccggaaggggtacctacggccctttacgggtacccgttacgggtaaccgttaccgaccccgggtaccgaccgggttaccccgg

SEQ ID NO: 273464 - DNA, 717 bp, Homo sapiens
  misc_feature: GYAE6OF02F262S.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgcttgggttttccttgttgcttattttagaaggtgtccagtgtgaggtgcagctgggtggagtcgtgggggagccgtggtcaagccgtggggggtccctgagactctcctgtgcacgcctcgtggacttccaacctttgagttggaacgggccgtattccgaccattcctaccagagaccaaccgccaaagaacctcactgtactctagacaaagtcgaaccaccgtagagacgccgaaggacgacggtctgtattattagttgtgcgagtagttacgaaccgtagttacggttttcggggccggtacccgaaacgtaacgtaaccttaattaaccgtaacgtacggtactagtacgggtaccgttcggtcggggaccgtaacgggacccgaacccggtaccggtacccgtacccggttcccttacccgtcccgtaccgtacccgtaccccaacccggaaccgggtaccctaccggtttccccgggttcccctttccccccgtccggtaccccgtaccccgttacccgtacccgaaaccggtaccacccgtacccgttccgggtacccgggg

SEQ ID NO: 273465 - DNA, 760 bp, Homo sapiens
  misc_feature: GYAE6OF02GOSI0.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctggtcaagccgtggggggtccctggagacctctcctgtcgcagcctcgtggacttccaccttcagtggaacgggccgacttccaccactctccagacgacaaccgaccaagaacctcactgtatctgacaatacgaaccaacctgacgacgaccgaaggaccacggtctggtagttatttagttgtcggtacgtaggtacgttacgtaaccgtacggtttacggtttttcggggggacccgggtaaccccggaaaccggaaacggtaaccgtttaaacgtttaacccgttaaccgttaaccggtaccgtacgttacggggtacgggttccggtaccgggggaacccggtaaacgggtacccgaaccccgtacgggtaccccgaaccggtttccctacccgttaccgaccgtcccgtaccccgtaaccggtacccgggtacccgtaccggttcccggttccccgttcccccgtaccgggacccccttacccctcccgttaacccgaaccgtaccggacccgtacccgtccgggtacccgggg

SEQ ID NO: 273466 - DNA, 889 bp, Homo sapiens
  misc_feature: GYAE6OF02HRIUA.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttctgtgctatttagaaggtgtccagtgtgagtgcagcgtggtggagtcgtgggggacgtcctaggtcaagccgtcgggggtccctgacgactctcctaggcgtcacgccttctaggtactttccgaaccgtttcgaaggttcggaaacgggtaccgtaacgttaccaaccctagtcctacccgaagtacgaaccaaaccggtccaaaagtaaccttccaacttacggtaattaccgtaacggacaaaaacgtcggaaaaccctaacccgtaggaaacggaccgacccgggtaagggaccgaaccggtcgttaacggttaagttaacgttttagttacggtaacgtaccggtaagggttaacgttaaaccggtaaaccccgtaacgggtttaacggttttaccggggggaccggtaaaccccggtaaaaaggtaaaccgtaaacgtttaaacgtttaaccgtaaaccggtaaacgggtaccttaaacggtaccgggttaaaccggttcggacggggtaacccggaaacggtacccgtaaaccggacccgggttaaccgtaccccggttaccctttacccgtaccgtaccgaccccgttaccgaaacccggaacgggtcccccttaaggttccccgggttttacccctaaccccccgggttcgggtaacccctaccccggttaccccgttaacccgaaaggaccccgtaaccgttaccccggttacgggtcccgggg

SEQ ID NO: 273467 - DNA, 611 bp, Homo sapiens
  misc_feature: GYAE6OF02GPW4P.43.79.H02.1.454.CMB.1.raw
  modified_base (320)..(320): a, c, t, g, unknown or other
  misc_feature (320)..(320): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (519)..(519): a, c, t, g, unknown or other
  misc_feature (519)..(519): n is a, c, g, or t
  modified_base (594)..(594): a, c, t, g, unknown or other
  misc_feature (594)..(594): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgtgcagcctctggattccaccttcagtggaacgggccgattccaccatctccagagacacgccaagacncatgtatcagacaaatcgaaccaccgtagagacgaccgaggacacggctgtntattagttgngcgagtagttacgaaccgtacgtagttttcggggccggtacccgaacggaacgtacttaacttaccgtacgtacggtacagtggtacgtcgtcgggtaccgacgaccgaccgtacggtacctaccgtcctcctaccncgacccgtccgtaaccgaccggaccgaccgtccgttccgttcccgtccgtaccgtacccgtccctccaaccgacnccgtaccgtcgtccggg

SEQ ID NO: 273468 - DNA, 790 bp, Homo sapiens
  misc_feature: GYAE6OF02IP96S.43.79.H02.1.454.CMB.1.raw
  modified_base (136)..(136): a, c, t, g, unknown or other
  misc_feature (136)..(136): n is a, c, g, or t
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
tcagtgtgagtagtcacgaccggtgctcgatttagtgtcacacgaagggaaaggggcagcttcagctgtggtagagaagacaggattcaggacaatctccagcatggccggcttccctctcctcctcaccctcctnactcactgtgcagggtcctgggcccagtctgtgctgactcagtcaccctnagcgttcctcgggacccccgggnacggaggtccaccgacttctccttgttcctaggaacnctagcctaccaacacgtacgggaaattattagtntaattagttacggtaacagtaccgtacggccttaacccgaaaggtaaacccccggggtaccccctaaaacttttcccgtacgtaaacttacccgtttaaaggtaaaccgggtaaattaaaccgttccgaaaccgggtcccgtacccggttaccggtaccggggtaccctcggtaccgtaacgtttcctcgttccgtaccttaccgaggttcgtacggtacaccgttcgaccggtcccctcggacgtacccctagtaccggtagggttcccgggccgttacccgggaccgggtaaaggtcgaaccggtgggtcttaaggttaacggttttacctaggttcgtacgataacgggtagagttacgggtatccgaagtacccggtgttaacggtgggttaccggtaggttccgggttacggttaccggggaaggttacccgggaacgtaacggttcccgtaaccggttaccgacggtttaggccccggtaacggttcccgaaccgttccccggg

SEQ ID NO: 273469 - DNA, 410 bp, Homo sapiens
  misc_feature: GYAE6OF02F0W9Q.43.79.H02.1.454.CMB.1.raw
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (392)..(410): a, c, t, g, unknown or other
  misc_feature (392)..(410): n is a, c, g, or t
tcagtgtgagtagtcacgaccggtgctcgatttagtgtcacacgaagggaaagggccgattcaccatctccagagacaacgccaagaactcactgtatctgcaaatgaacaccctgagagccgaggacacggctgtgtattattgtgcgagagttgaaccacgatttttggggcggcccaacgaagactattactactacggcatggacgtctggggccaaggcaccacgggtcaccgtctcctcagcctccaccaagggcccatccggtcttccccctggccaccccttccnccaagagcacctcgtgggggcacagccggccctgggctcgcctggtcaaggctacttccgactacncacactgagcgggntggcaggccgnactagncnnnnnnnnnnnnnnnnnnn

SEQ ID NO: 273470 - DNA, 931 bp, Homo sapiens
  misc_feature: GYAE6OF02FLU0E.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctggtttcctgttgcttattttagagttgtccagtgtgaggtgcgagcgtgggtcggagtcggtggggggagtccgtggtcgaacggccggttcgggggggtccctggacgtactccgttacgtcgtagcctacggccttcgtgtaacgttcctacccttacggagttacggaaccggggtcctacttccgaccctaacttccccgtacgaagtacgtaacccgaaaccggaccctaaaacgggtacccttaacgtacgttacgtaaccttaccggttagaaccgtaaagttaacccgaaaccgtaccccgtaggtaacggtaccgggtaacccggtaaggtaacccacggggtacgtttacgtaggtttaacttagttcggttacgggaccgtaaggttacgttaaccggtaccgtaacggtttaagggttttcggggggaaacccgtacccggtaaaaccggaacggttaacctttaaacgttaaccggttaccggttaaccgggtaccttaacgggttacccgtaaccgggttccgggtacgggtaaccggacggtaacccgtaacccggtacggttcccaacccgggtttaccctaccggtttaacccgacccgttacccgttacccctaaccgggtaacccgggttaccccgttaccggttcccccggggttaacccccttttccccggtaacccggttacccccgttaaccccttaaccccggttaaccgaaccggttaaccccggtcccgttacccgggtaccccgggttacccgggg

SEQ ID NO: 273471 - DNA, 645 bp, Homo sapiens
  misc_feature: GYAE6OF02HD4YX.43.79.H02.1.454.CMB.1.raw
  modified_base (260)..(260): a, c, t, g, unknown or other
  misc_feature (260)..(260): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagctctcctgtgcagcctntgattccaccttcagtgaacgggccattcaccatcctccagacgacaacgccaagactcactgtactctgacaaatcgaaccaccgtgaagacgccgaggaccacggctgtacgttattagttgtgacgtagtacgttacgaaccgtaacgttaggttttacggggaccggaacccgtaacgtaacgtaacttacttaactacgtacggtactagtacggacgtcgtcgggaccgaacggccgtaaccgacgtaccgtacccgtccgtccgtacgaccgcccgtacccgaccgaccgtacccgtaccggtcccgttcccgttcccccgtcgtaccctaccccgtacctacccgaacgtaccgacccgtacccgtcggtacccggg

SEQ ID NO: 273472 - DNA, 968 bp, Homo sapiens
  misc_feature: GYAE6OF02H2U2D.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgcttgggttttccttgttgacttattttagaaggtgtccagtgtgaggtgcagctggtggagtcgtgggggaggcctggtcaaggccgtcgggggtccctgagactctccgtgtgcgacgtcctcgtaggctttaccactttcgaggtaggaacgggccgtaacttccaaccgtattcctaccgaagtaacgaaccgaacccggtaccaaaacggtaaaccctacgtaaccgttacgttaacttccgtaacgtaaacgtaaaagtaacccggtaaacccgtacccggttaaggaacgggaaccggtaacccggtaaacgggaaacccggttaccgggtacgtttaggggtttaaacgttttaacgtttaacgtttttcgggttaacgggaccggttaaagggttacggttttaaaccgggtaaaccccggtttaaacggggttttaacgggttttttacccgggggggaccccggtaaaccccggtaaaacggtaaaaccgttaaaccgttaaacgtttaaacccgttaacgggtaaaccgaccgtttaagggtaaccgggttaccgggttaccgggtacggggaaccccgaaacgggtcccgtaaccccggtaacggtttaccccgtaaccccggttacccgttacccgttaaccgacccggttaccccttaacccgaaacccgggtaacccggggtccccttaaccgggttccccggttacccccgtttacccccggttacccggaccccgtaaccccccgttcccgtaaacccgacccgggtaacccggtaccccgttacccgggtaccgggacccgggg

SEQ ID NO: 273473 - DNA, 772 bp, Homo sapiens
  misc_feature: GYAE6OF02IZR3J.43.79.H02.1.454.CMB.1.raw
  modified_base (384)..(384): a, c, t, g, unknown or other
  misc_feature (384)..(384): n is a, c, g, or t
  modified_base (473)..(473): a, c, t, g, unknown or other
  misc_feature (473)..(473): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgcttgggttttccttgttgctattttagaaggtgtccagtgtggaggtgcagtctgggtggtagtccgtgggggagccgtgggtcaacggtccgttcggggggtccctggacgactccttcctgtcgcacggcctcgtagtacgttccaacctttcgacgttaggaacggggtccaacgttaccaccgtactccttaccagaacgaccaaccgtccaaaggaactcaacgttcgattcncgacaaagtcgaaacccgaccaggtaacgacgtccggaacggtacggtaccggggcttacggtagttactttagttcgggtagaccggnggttattacgtaaccgacggtttaaggtttcggggtaccggtaccaacgtaacgaacttacgttaacgtaacctaacggtacgtacgttacggtaccggttcgtacggggaaccaacgggtacctaacccggtacggtacccgtaccggtacccgttcccgtacgtacccgacccgttacgaaccccgacggtaccctacgttaccgggttacccctttccccggtccggtaccccgttaaccccgttccccgtaccgtaaccggtaacccgtcccgtaccggttcccgggtaccgggg

SEQ ID NO: 273474 - DNA, 801 bp, Homo sapiens
  misc_feature: GYAE6OF02IVNEU.43.79.H02.1.454.CMB.1.raw
  modified_base (220)..(220): a, c, t, g, unknown or other
  misc_feature (220)..(220): n is a, c, g, or t
  modified_base (436)..(436): a, c, t, g, unknown or other
  misc_feature (436)..(436): n is a, c, g, or t
tcagtgtgagtagtcacgaccggtgctcgatttagtgtcacacgaagggaaagggggcagcttcagctgtggtagagaagacaggattcaggacaatctccagcatggcccggcttccctctcctcctccaccctccctcactcactgtgcgagggtcctgggcccagttctgtgctgacctcatccgaccctcagtccgtcgtccggggaccccccggnaggtacgggtccaccgattcttcgtttgttcgtaggaactcgacgtacctaccaactacgtacggtaaacttattatacgttattagttcgtaccgagacctacgcctaaccgaaggaaccccgtaacccctaacttcctatactaccgtagtaagaacttatccgacggcccgttaccgtacggaccggggttacctacgaaccgttattacccncggttacgtcccgttaccgtaacggttcctacggtcccctacccgtactacccgtcccctacccggttcgaccccttaacgtacggtacggggttcccggtcccgtccgggtacggaacgttaacggtcggtaccgtgttaacgttactttaacggttcgtctacggacgacgttccgtagggtaccgtagtaacccgtaccgcggttaccggttagggacgggtttcgggttacggttacgtttaggggttccccggggaaagggtacccggtaaaaccggtacggtttacccggtcccggttaaacccggtttccggtttaaacgggccccggaccggttaaaccccgggtgttccccccggg

SEQ ID NO: 273475 - DNA, 881 bp, Homo sapiens
  misc_feature: GYAE6OF02GYBRZ.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctcgctgggttttccttgttgcttattttagaggtgtcagtgtgaggtgcagcgtggtggagtcgtgggggagcctggtcaaggccgtgggggtccctgacgctctcctgtgcagcctcgtggtattccgtacctttcgaggtacgggaaacgggtcccgtaagtttacccaaccctacgttaccgtaccccgaaaggtaaccggaaacccgaaaccggtacccgaaaacggtaacccttcaacccgtttaggttaacttcgtacgtaacgtaaaacgttacggaaaaccctacccgtaggaacggtaacggacccgggtaacgggaccgacgggtacgttaggttaggttaactttaaggttcggtacggtaacgtagggttaacgttacggaaacccgttacggtttaacgggttttacgggggacccggtaacccgtaaacggtaacgtaacgttaacgtttaaccgtaaccgttacggacctaggtacggtaccgttcggttacggggacccgtaacggacccgtaacccggaccggttacccgtacccggttacccgttaccccgttaccgaccgttaacccccgtacccgaacccggaccggggtaccccgttaaccggttccccgggtttaccccgtttcccccggtacccggttacccccgtaacccccgttacccggtaaccccgtaaccgggacccgttaccccggtacccgttccggggtaccccgggg

SEQ ID NO: 273476 - DNA, 789 bp, Homo sapiens
  misc_feature: GYAE6OF02F52PT.43.79.H02.1.454.CMB.1.raw
  modified_base (278)..(278): a, c, t, g, unknown or other
  misc_feature (278)..(278): n is a, c, g, or t
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggacgccgtggtcaagccgtggggggtccctgagactctcctgtgcagcctcgtggacttcaccttnaggtagaacgggccattcaccatctcagagacaacgacaaagactcactagtactctacgacaaatacgaaacctccgtagaacgaacggaccggaacgggaccacgggtactaggttacgtaatttaacgttggacgtacggtaaggtacggtttacgaaacccgtaacggtttacgggttttacgggggaacccggtaaccccgtaaacggaaacgtaacgtttaaacgttaaccgttaacggttaaccgggtactaaacggttacgggtaccggttaccgggtcggggaacccgaaacgggaccgaaacccggtaccggtaccgtaacccgttcccgttacccgtaccgtaccggtcccctaacccgtaaccccgaaccgggtacccgtaaccggtttaccccggttaccccttaccccccggtaaccggtacccccttaacccccgttcccgttaacccccggaaaggttacccgtaccccgtacccggttacccgggtacccgggg

SEQ ID NO: 273477 - DNA, 711 bp, Homo sapiens
  misc_feature: GYAE6OF02JEU9R.43.79.H02.1.454.CMB.1.raw
  modified_base (201)..(201): a, c, t, g, unknown or other
  misc_feature (201)..(201): n is a, c, g, or t
  modified_base (580)..(580): a, c, t, g, unknown or other
  misc_feature (580)..(580): n is a, c, g, or t
  modified_base (590)..(590): a, c, t, g, unknown or other
  misc_feature (590)..(590): n is a, c, g, or t
  modified_base (630)..(630): a, c, t, g, unknown or other
  misc_feature (630)..(630): n is a, c, g, or t
  modified_base (645)..(645): a, c, t, g, unknown or other
  misc_feature (645)..(645): n is a, c, g, or t
  modified_base (666)..(666): a, c, t, g, unknown or other
  misc_feature (666)..(666): n is a, c, g, or t
  modified_base (688)..(688): a, c, t, g, unknown or other
  misc_feature (688)..(688): n is a, c, g, or t
tcagtgtgagtagtcacgaccggtgctcgatttagtgtcacacgaagggaaagggggagagaggagccttagccctggattccaaggccctatccacttggtgatcagcactgagcaccgaggattcaccatggaactggggcctccgcgttcgggttttccttgttgtcttattttagaaggtgtcctagtgtagaggtncgagtcgtgggtcggagttcggtagggggacggtccgttggtacaacggtccgggttccggggggtaccctggacgtacccttcggtaccttggtacgcgtaacgtcctacgtagtcttaccctaccttgaaggttggaaccggtaccgtagtacccactacgtacctaccgaagtaccaaccacgtaccaagaacctaccgtaattacgtattacgacgaactaacacgtaacctaccgagacggaccgaccgaagtcccgaaggtcgtagttagtacttgtacgtgacgtagtacgtacgaacgtgggttttacggtcggacccggtaaccaaagtaacgtactaattaccgagtacgcttagccgggtaactcggnggtaaacccnggaccctaacgcgtacccgttcgaccgttcacgttacccnctaaccgacgcccgntccgtttacccgcccttaccncccgtaccctacccttagaccncgcttacccggcgtcggaacccg

SEQ ID NO: 273478 - DNA, 943 bp, Homo sapiens
  misc_feature: GYAE6OF02IOZSD.43.79.H02.1.454.CMB.1.raw
tcagtgtgagtagtcacgaccggtgctcgatttagtgtcacacgaagggaaagggggagagaggagccttagccctggattccaaggcctatccacttggtgatcagcactgagcaccgaggattcaccatggaactggggctccgcgttgggttttccttgttgcttatttagaaggtgtccagtgtgaggtgcagcgtggtggagtcggtaggggggaggccgtggtacgaaggccggtcggggggtccctaggacgtaccttctccgtggtcgccgacgtcctcggtggtacttcctaccgttcgaggtacgggaacgggccgtaacttaccgaacccgtacttaccgtaccgaacggaaccgaaccgaaaccgaacccgaaaaccggtaaccttaccgtaaccgttacggttaaccttcgtaaccggtaaaccttaaaacgtaaccggtaaacccgtaaccccggttaaggaaaccggacccggtaaacccggggaaacggtaacccgggttaaccggtaccggttagggtttaaacgtttaccgttaaggtttcggaccgggtacggttaacggtaacggtttaaccggaaaccggttacggtttacgggtttaccgggggaacccgtaacccggtaaaggtaaacgtacgtttaaacgttaccgtaaccgtacggtacctaggtacggtacgtcggtacgggaccgaacggtccgaaccggtaccgtaccgtacccgttccgttaacccgtccgtacccgtaacccgtacccgggaacccgtacccgggtaaccccgttccgggttacccccggttcccccgtttaacccccccggccggtttaacccccccgttaccccgttaacccccggttaaccggaaacccgggttacccggtaccccgtttaacccccggggtcggggttaaccccggggg

SEQ ID NO: 273479 - DNA, 826 bp, Homo sapiens
  misc_feature: GYAE6OF02IAE3A.43.79.H02.1.454.CMB.1.raw
  modified_base (215)..(215): a, c, t, g, unknown or other
  misc_feature (215)..(215): n is a, c, g, or t
tcagtgtgagtagtcacgaccggtgctcgatttagtgtcacacgaagggaaagggggagagaggagccttagccctggattccgaaggcctatccacgttggtgatcagcactgagcaccgaggattccaccagtggaactggggctccgcttcgggttttcccttgttgtcttaagttttaggaaggttcgtccgtagtggtggaggttcgacngcgtggtggagttccggtgggggacggtccgtgggtacgtaacggcccggttgggggggtccccttaggaacgtccgttccgtaccgtggttaacgccgtacggtccccgttgttacgggttaacttaccggttaaacccctttgtaacggttacggtaaaacggggtccgtaccgtttaccgaaccttaacgtccttaaccgtaagaacggaacctaaccggaaactacgtaaaaccgttcctaacgttacggtactaccgtacggtaacaaacgttcgaaacctaacccgttagacgtaccgacggaaacggtacgaccggtccgttaagtgttaaacgtttggttacgtgtacggtaagtacggttaccgaacggttaacggttacgggttttacgggaccggtacccgtaaaggtaacgtaacgtacgttaaccgtaaccgtaacgtacgtacggtacgtaccgtcgggtacggaccgtaacggaccgtaacccgtaccggtaaccgtccgtaaccgtccgtaacctcgacctcgtaaccgaccgtcgtaaccgtcgtccctccgtccgtacctccgtccaccgtacgcgtaccgacgtcggaacgg

SEQ ID NO: 273480 - DNA, 690 bp, Homo sapiens
  misc_feature: GYAE6OF02G40U8.43.79.H02.1.454.CMB.1.raw
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (602)..(602): a, c, t, g, unknown or other
  misc_feature (602)..(602): n is a, c, g, or t
tcagtgtgagtagtcacgaccggtgctcgatttagtgtcacacgaagggaaaggggcagcttcagctgtggtagagaagacaggattcaggacaatctccagcatggccggcttcctctcctcctcacctcctcactcactgtgcagggtcctgggcccagtctgtgctgactcagtccaccctcacgcgtcgtaccgggaccccggcaaggtacgggtccaccgacttcgtacgttcgttactagggaagtcgacggtcctaaccgaaactacgtacgggtaaaagtttaatttagttagtttaattaaggttttacggtaaccccgagtaccgaacggtacccgttaaccccgaaaacggaaccccggtaccccctaaaaggttccctaacctacgtactaagtaacggaaataactacgtacgaccggtaccctggaaccggggttcctaggaaccgtacttcgtcgtacggtacctaccgtaggtacctggaccctacgtcaacggtccctccgtcgacctagtcgaggtcggtacgccggtacgagtacgtgtaggcttagtattatgtgnacgtanacgtagtaggtactagaacnggtaccgttagtgggtcgttaggttacgtaggtaccgggaggacgacgaacgtcgtacgtacgttacgacgcgacgaccgaggtcccg

SEQ ID NO: 273481 - DNA, 125 bp, Homo sapiens
  misc_feature: GYAE6OF01BNIAY.49.41.D08.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaaagggaagggctggccctgacgtgtttctgttcccgccctcctctctctcgactctgagcgggctggcaaggcgcatagn

SEQ ID NO: 273482 - DNA, 125 bp, Homo sapiens
  misc_feature: GYAE6OF01DS3CX.49.41.D08.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaaagggaaagggctggccctgacgtgtttctgttcccgcctcctctctctcgactctgagcgggctggcaaggcgcatagn

SEQ ID NO: 273483 - DNA, 163 bp, Homo sapiens
  misc_feature: GYAE6OF01DANNM.49.41.D08.1.454.CMB.1.raw
  modified_base (120)..(120): a, c, t, g, unknown or other
  misc_feature (120)..(120): n is a, c, g, or t
  modified_base (126)..(163): a, c, t, g, unknown or other
  misc_feature (126)..(163): n is a, c, g, or t
tcagagtcgagagacacgaccggtgctcgatttagtcacgcgagaaagggaagggtcggcccgtgacgtgtttctgttcccgccctcctctctctcgactctgagcgggctggcaaggcncatagnnnnnnnnnnnnnnnnnnnnnnnnnnnnnnnnnnnnnn

SEQ ID NO: 273484 - DNA, 125 bp, Homo sapiens; identical to SEQ ID NO: 273481
  misc_feature: GYAE6OF01BESUW.49.41.D08.1.454.CMB.1.raw
  modified_base (125)..(125): a, c, t, g, unknown or other
  misc_feature (125)..(125): n is a, c, g, or t

SEQ ID NO: 273485 - DNA, 131 bp, Homo sapiens
  misc_feature: GYAE6OF01A07B4.49.41.D08.1.454.CMB.1.raw
  modified_base (123)..(131): a, c, t, g, unknown or other
  misc_feature (123)..(131): n is a, c, g, or t
tcagagtcgagagacacgaccggtgctcgatttagtcacgcgagaaagggaagggtggccctgacgtgtttctgttcccgccctcctctctctcgactctgagcggctggcaaggcgcatagnnnnnnnnn

SEQ ID NO: 273486 - DNA, 126 bp, Homo sapiens
  misc_feature: GYAE6OF01EHK9P.49.41.D08.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaaagggaaggggctggccctgacgtgtttctgttcccaccctcctctctctcgactctgagcgggctggcaaggcgcatagn

SEQ ID NO: 273487 - DNA, 127 bp, Homo sapiens
  misc_feature: GYAE6OF01EAQFW.49.41.D08.1.454.CMB.1.raw
  modified_base (127)..(127): a, c, t, g, unknown or other
  misc_feature (127)..(127): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggcgcatagn

SEQ ID NO: 273488 - DNA, 124 bp, Homo sapiens
  misc_feature: GYAE6OF01B8UH5.49.41.D08.1.454.CMB.1.raw
  modified_base (123)..(124): a, c, t, g, unknown or other
  misc_feature (123)..(124): n is a, c, g, or t
tcagagtcgagagacacgaccggtgctcgatttagtcacgcgagaaagggaaagggtggccctgacgtgttctgttcccaccctcctctctctcgactctgagcggctggcaaggcgcatagnn

SEQ ID NO: 273489 - DNA, 123 bp, Homo sapiens
  misc_feature: GYAE6OF01BVRK5.49.41.D08.1.454.CMB.1.raw
tcagagtcgagagacacgaccggtgctcgatttagtcacgcgagaaagggaagggctggccctgacgtgtttctgttcccacctcctctctctcgactctgagcgggctggcaaggcgcatag

SEQ ID NO: 273490 - DNA, 127 bp, Homo sapiens; identical to SEQ ID NO: 273487
  misc_feature: GYAE6OF01EDPG0.49.41.D08.1.454.CMB.1.raw
  modified_base (127)..(127): a, c, t, g, unknown or other
  misc_feature (127)..(127): n is a, c, g, or t

SEQ ID NO: 273491 - DNA, 174 bp, Homo sapiens
  misc_feature: GYAE6OF01BEDFE.49.41.D08.1.454.CMB.1.raw
  modified_base (134)..(174): a, c, t, g, unknown or other
  misc_feature (134)..(174): n is a, c, g, or t
tcagagtcgagagaacacgaccggtgctcgatttagtcacgcgagaaagggaaaggggtcgtggtccctgacggtgtttctgttcccaccctcctctctctcgactctgagcggctgggcaaggccgcatagcnnnnnnnnnnnnnnnnnnnnnnnnnnnnnnnnnnnnnnnnn

SEQ ID NO: 273492 - DNA, 139 bp, Homo sapiens
  misc_feature: GYAE6OF01A9KC8.49.41.D08.1.454.CMB.1.raw
  modified_base (128)..(139): a, c, t, g, unknown or other
  misc_feature (128)..(139): n is a, c, g, or t
tcagagtcgagagacacgaccggtgctcgatttagtcacgcgagaaagggaaaggggctggccctgacgtgtttctgttcccgccctcctctctctcgactctgagcgggctggccaaggcgcatagnnnnnnnnnnnn

SEQ ID NO: 273493 - DNA, 126 bp, Homo sapiens
  misc_feature: GYAE6OF01CTQ09.49.41.D08.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaaagggaaggggctggccctgacgtgtttctgttcccgccctcctctctctcgactctgagcgggctggcaaggcgcatagn

SEQ ID NO: 273494 - DNA, 139 bp, Homo sapiens
  misc_feature: GYAE6OF01BDGXI.49.41.D08.1.454.CMB.1.raw
  modified_base (127)..(139): a, c, t, g, unknown or other
  misc_feature (127)..(139): n is a, c, g, or t
tcagagtcgagagacacgaccggtgctcgatttagtcacgcgagaaagggaagggggctggccctgacgtgtttctgttcccaccctcctctctctcgactctgagcgggctggcaaggcgcatagnnnnnnnnnnnnn

SEQ ID NO: 273495 - DNA, 127 bp, Homo sapiens
  misc_feature: GYAE6OF01A6DW6.49.41.D08.1.454.CMB.1.raw
  modified_base (127)..(127): a, c, t, g, unknown or other
  misc_feature (127)..(127): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgcatagn

SEQ ID NO: 273496 - DNA, 126 bp, Homo sapiens; identical to SEQ ID NO: 273486
  misc_feature: GYAE6OF01BLHPM.49.41.D08.1.454.CMB.1.raw
  modified_base (126)..(126): a, c, t, g, unknown or other
  misc_feature (126)..(126): n is a, c, g, or t

SEQ ID NO: 273497 - DNA, 126 bp, Homo sapiens; identical to SEQ ID NO: 273486
  misc_feature: GYAE6OF01EWK1S.49.41.D08.1.454.CMB.1.raw
  modified_base (126)..(126): a, c, t, g, unknown or other
  misc_feature (126)..(126): n is a, c, g, or t

SEQ ID NO: 273498 - DNA, 126 bp, Homo sapiens; identical to SEQ ID NO: 273486
  misc_feature: GYAE6OF01A1Z3P.49.41.D08.1.454.CMB.1.raw
  modified_base (126)..(126): a, c, t, g, unknown or other
  misc_feature (126)..(126): n is a, c, g, or t

SEQ ID NO: 273499 - DNA, 124 bp, Homo sapiens
  misc_feature: GYAE6OF01BOHQV.49.41.D08.1.454.CMB.1.raw
  modified_base (124)..(124): a, c, t, g, unknown or other
  misc_feature (124)..(124): n is a, c, g, or t
tcagagtcgagagacacgaccggtgctcgatttagtcacgcgagaaagggaagggctggccctgacgtgtttctgttcccacctcctctctctcgactctgagcgggctggcaaggcgcatagn

SEQ ID NO: 273500 - DNA, 131 bp, Homo sapiens
  misc_feature: GYAE6OF01C1MLE.49.41.D08.1.454.CMB.1.raw
  modified_base (126)..(131): a, c, t, g, unknown or other
  misc_feature (126)..(131): n is a, c, g, or t
tcagagtcgagagacacgaccggtgctcgatttagtcacgcgagaaagggaaggggctggccctgacgtgtttctgttcccaccctcctctctctcgactctgagcgggctggcaaggcgcatagnnnnnn

SEQ ID NO: 273501 - DNA, 122 bp, Homo sapiens
  misc_feature: GYAE6OF01EK1WO.49.41.D08.1.454.CMB.1.raw
  modified_base (122)..(122): a, c, t, g, unknown or other
  misc_feature (122)..(122): n is a, c, g, or t
tcagagtcgagagacacgaccggtgctcgatttagtcacgcgagaaaggaagggctggccctgacgtgtttctgttcccgcctcctctctctcgactctgagcggctggcaaggcgcatagn

SEQ ID NO: 273502 - DNA, 125 bp, Homo sapiens
  misc_feature: GYAE6OF01B2YXA.49.41.D08.1.454.CMB.1.raw
tcagagtcgagagacacgaccggtgctcgatttagtcacgcgagaaagggaaagggctggccctgacgtgtttctgttcccaccctcctctctctcgactctgagcgggctggcaaggcgcatag

SEQ ID NO: 273503 - DNA, 126 bp, Homo sapiens; identical to SEQ ID NO: 273493
  misc_feature: GYAE6OF01DFS4T.49.41.D08.1.454.CMB.1.raw
  modified_base (126)..(126): a, c, t, g, unknown or other
  misc_feature (126)..(126): n is a, c, g, or t

SEQ ID NO: 273504 - DNA, 127 bp, Homo sapiens; identical to SEQ ID NO: 273495
  misc_feature: GYAE6OF01E0AP7.49.41.D08.1.454.CMB.1.raw
  modified_base (127)..(127): a, c, t, g, unknown or other
  misc_feature (127)..(127): n is a, c, g, or t

SEQ ID NO: 273505 - DNA, 127 bp, Homo sapiens; identical to SEQ ID NO: 273487
  misc_feature: GYAE6OF01D6NAA.49.41.D08.1.454.CMB.1.raw
  modified_base (127)..(127): a, c, t, g, unknown or other
  misc_feature (127)..(127): n is a, c, g, or t

SEQ ID NO: 273506 - DNA, 141 bp, Homo sapiens
  misc_feature: GYAE6OF01EY6E3.49.41.D08.1.454.CMB.1.raw
  modified_base (127)..(141): a, c, t, g, unknown or other
  misc_feature (127)..(141): n is a, c, g, or t
tcagagtcgagagacacgaccggtgctcgatttagtcacgcgagaaagggaaagggctggccctgaacgtgtttcctgttcccgcctcctctctctcgactctgagcgggctggcaaggcgcatagnnnnnnnnnnnnnnn

SEQ ID NO: 273507 - DNA, 136 bp, Homo sapiens
  misc_feature: GYAE6OF01DRU9V.49.41.D08.1.454.CMB.1.raw
  modified_base (126)..(136): a, c, t, g, unknown or other
  misc_feature (126)..(136): n is a, c, g, or t
tcagagtcgagagacacgaccggtgctcgatttagtcacgcgagaaagggaaggggctggccctgacgtgtttctgttcccaccctcctctctctcgactctgagcgggctggcaaggcgcatagnnnnnnnnnnn

SEQ ID NO: 273508 - DNA, 126 bp, Homo sapiens
  misc_feature: GYAE6OF01EE1KB.49.41.D08.1.454.CMB.1.raw
tcagagtcgagagacacgaccggtgctcgatttagtcacgcgagaaagggaaaggggctggccctgacgtgtttctgttcccgccctcctctctctcgactctgagcgggctggcaaggcgcatag

SEQ ID NO: 273509 - DNA, 128 bp, Homo sapiens
  misc_feature: GYAE6OF01DMKJL.49.41.D08.1.454.CMB.1.raw
  modified_base (127)..(128): a, c, t, g, unknown or other
  misc_feature (127)..(128): n is a, c, g, or t
tcagagtcgagagacacgaccggtgctcgatttagtcacgcgagaaagggaaaggggatggccctgacgtgtttctgttcccaccctcctctctctcgactctgagcgggctggcaaggcgcatagnn

SEQ ID NO: 273510 - DNA, 126 bp, Homo sapiens; identical to SEQ ID NO: 273493
  misc_feature: GYAE6OF01C5376.49.41.D08.1.454.CMB.1.raw
  modified_base (126)..(126): a, c, t, g, unknown or other
  misc_feature (126)..(126): n is a, c, g, or t

SEQ ID NO: 273511 - DNA, 127 bp, Homo sapiens; identical to SEQ ID NO: 273487
  misc_feature: GYAE6OF01C8WOU.49.41.D08.1.454.CMB.1.raw
  modified_base (127)..(127): a, c, t, g, unknown or other
  misc_feature (127)..(127): n is a, c, g, or t

SEQ ID NO: 273512 - DNA, 128 bp, Homo sapiens
  misc_feature: GYAE6OF01B9L4R.49.41.D08.1.454.CMB.1.raw
  modified_base (127)..(128): a, c, t, g, unknown or other
  misc_feature (127)..(128): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggcgcatagnn

SEQ ID NO: 273513 - DNA, 127 bp, Homo sapiens; identical to SEQ ID NO: 273487
  misc_feature: GYAE6OF01AFU3G.49.41.D08.1.454.CMB.1.raw
  modified_base (127)..(127): a, c, t, g, unknown or other
  misc_feature (127)..(127): n is a, c, g, or t

SEQ ID NO: 273514 - DNA, 139 bp, Homo sapiens
  misc_feature: GYAE6OF01BASTJ.49.41.D08.1.454.CMB.1.raw
  modified_base (127)..(139): a, c, t, g, unknown or other
  misc_feature (127)..(139): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggcgcatagnnnnnnnnnnnnn

SEQ ID NO: 273515 - DNA, 146 bp, Homo sapiens
  misc_feature: GYAE6OF01BH6B0.49.41.D08.1.454.CMB.1.raw
  modified_base (128)..(146): a, c, t, g, unknown or other
  misc_feature (128)..(146): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggccgcatagnnnnnnnnnnnnnnnnnnn

SEQ ID NO: 273516 - DNA, 125 bp, Homo sapiens
  misc_feature: GYAE6OF01EZYQP.49.41.D08.1.454.CMB.1.raw
tcagagtcgagagacacgaccggtgctcgatttagtcacgcgagaaaggaaaggggctggccctgacgtgtttctgttcccaccctcctctctctcgactctgagcgggctggcaaggcgcatag

SEQ ID NO: 273517 - DNA, 126 bp, Homo sapiens; identical to SEQ ID NO: 273486
  misc_feature: GYAE6OF01DYGKC.49.41.D08.1.454.CMB.1.raw
  modified_base (126)..(126): a, c, t, g, unknown or other
  misc_feature (126)..(126): n is a, c, g, or t

SEQ ID NO: 273518 - DNA, 138 bp, Homo sapiens
  misc_feature: GYAE6OF01A7DMW.49.41.D08.1.454.CMB.1.raw
  modified_base (107)..(107): a, c, t, g, unknown or other
  misc_feature (107)..(107): n is a, c, g, or t
  modified_base (128)..(138): a, c, t, g, unknown or other
  misc_feature (128)..(138): n is a, c, g, or t
tcagagtcgagagacacgaccggtgctcgatttagtcacgcgagaaagggaaaggggcgtggccctgacgtgtttctgttcccaccctcctctctctcgactctgancgggctggcaaggcgcatagnnnnnnnnnnn

SEQ ID NO: 273519 - DNA, 127 bp, Homo sapiens; identical to SEQ ID NO: 273487
  misc_feature: GYAE6OF01DVWBI.49.41.D08.1.454.CMB.1.raw
  modified_base (127)..(127): a, c, t, g, unknown or other
  misc_feature (127)..(127): n is a, c, g, or t

SEQ ID NO: 273520 - DNA, 125 bp, Homo sapiens
  misc_feature: GYAE6OF01A5IHQ.49.41.D08.1.454.CMB.1.raw
tcagagtcgagagacacgaccggtgctcgatttagtcacgcgagaaagggaaggggctggccctgacgtgtttctgttcccaccctcctctctctcgactctgagcgggctggcaaggcgcatag

SEQ ID NO: 273521 - DNA, 154 bp, Homo sapiens
  misc_feature: GYAE6OF01CZFGT.49.41.D08.1.454.CMB.1.raw
  modified_base (123)..(123): a, c, t, g, unknown or other
  misc_feature (123)..(123): n is a, c, g, or t
  modified_base (129)..(154): a, c, t, g, unknown or other
  misc_feature (129)..(154): n is a, c, g, or t
tcagagtcgagagacacgaccggtgctcgatttagtcacgcgagaaagggaagggggctgggccctgacgtgtttcctgttcccaccctcctctctctcgactctgagcgggctggcaaggcncatagnnnnnnnnnnnnnnnnnnnnnnnnnn

SEQ ID NO: 273522 - DNA, 148 bp, Homo sapiens
  misc_feature: GYAE6OF01CI2ZE.49.41.D08.1.454.CMB.1.raw
  modified_base (121)..(121): a, c, t, g, unknown or other
  misc_feature (121)..(121): n is a, c, g, or t
  modified_base (127)..(148): a, c, t, g, unknown or other
  misc_feature (127)..(148): n is a, c, g, or t
tcagagtcgagagacacgaccggtgctcgatttagtcacgcgagaaagggaagggggctggccctgacgtgtttctgttcccgccctcctctctctcgactctgagcgggctggcaaggcncatagnnnnnnnnnnnnnnnnnnnnnn

SEQ ID NO: 273523 - DNA, 154 bp, Homo sapiens
  misc_feature: GYAE6OF01CWBVA.49.41.D08.1.454.CMB.1.raw
  modified_base (128)..(154): a, c, t, g, unknown or other
  misc_feature (128)..(154): n is a, c, g, or t
tcagagtcgagagacacgaccggtgctcgatttagtcacgcgagaaagggaagggggcgtggccctgacgtgtttctgttcccaccctcctctctctcgactctgagcgggctggcaaggcgcatagnnnnnnnnnnnnnnnnnnnnnnnnnnn

SEQ ID NO: 273524 - DNA, 127 bp, Homo sapiens; identical to SEQ ID NO: 273495
  misc_feature: GYAE6OF01CXFVM.49.41.D08.1.454.CMB.1.raw
  modified_base (127)..(127): a, c, t, g, unknown or other
  misc_feature (127)..(127): n is a, c, g, or t

SEQ ID NO: 273525 - DNA, 158 bp, Homo sapiens
  misc_feature: GYAE6OF01DCWUJ.49.41.D08.1.454.CMB.1.raw
  modified_base (157)..(158): a, c, t, g, unknown or other
  misc_feature (157)..(158): n is a, c, g, or t
tcagagtcgagagacacgaccggtgctcgatttagtcacgcgagaaagggaaaggggtgctcgatttagtcacgcgagaaagggaaggtggccctgacgtgtttctgttcccaccctcctctctctcgactctgagcgggctggcaaggcgcatagnn

SEQ ID NO: 273526 - DNA, 131 bp, Homo sapiens; identical to SEQ ID NO: 273500
  misc_feature: GYAE6OF01AR1FV.49.41.D08.1.454.CMB.1.raw
  modified_base (126)..(131): a, c, t, g, unknown or other
  misc_feature (126)..(131): n is a, c, g, or t

SEQ ID NO: 273527 - DNA, 127 bp, Homo sapiens
  misc_feature: GYAE6OF01CZMS4.49.41.D08.1.454.CMB.1.raw
  modified_base (127)..(127): a, c, t, g, unknown or other
  misc_feature (127)..(127): n is a, c, g, or t
tcagagtcgagagacacgaccggtgctcgatttagtcacgcgagaaagggaaaggggccggccctgacgtgtttctgttcccaccctcctctctctcgactctgagcgggctggcaaggcgcatagn

SEQ ID NO: 273528 - DNA, 135 bp, Homo sapiens
  misc_feature: GYAE6OF01AJRAI.49.41.D08.1.454.CMB.1.raw
  modified_base (127)..(135): a, c, t, g, unknown or other
  misc_feature (127)..(135): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggcgcatagnnnnnnnnn

SEQ ID NO: 273529 - DNA, 139 bp, Homo sapiens
  misc_feature: GYAE6OF01ATBWR.49.41.D08.1.454.CMB.1.raw
  modified_base (127)..(139): a, c, t, g, unknown or other
  misc_feature (127)..(139): n is a, c, g, or t
tcagagtcgagagacacgaccggtgctcgatttagtcacgcgagaaagggaaggggctggccctgacgtggtttctgttcccaccctcctctctctcgactctgagcgggctggcaaggcgcatagnnnnnnnnnnnnn

SEQ ID NO: 273530 - DNA, 127 bp, Homo sapiens; identical to SEQ ID NO: 273495
  misc_feature: GYAE6OF01B8F6Z.49.41.D08.1.454.CMB.1.raw
  modified_base (127)..(127): a, c, t, g, unknown or other
  misc_feature (127)..(127): n is a, c, g, or t

SEQ ID NO: 273531 - DNA, 127 bp, Homo sapiens; identical to SEQ ID NO: 273487
  misc_feature: GYAE6OF01CFA27.49.41.D08.1.454.CMB.1.raw
  modified_base (127)..(127): a, c, t, g, unknown or other
  misc_feature (127)..(127): n is a, c, g, or t

SEQ ID NO: 273532 - DNA, 127 bp, Homo sapiens; identical to SEQ ID NO: 273495
  misc_feature: GYAE6OF01AED4X.49.41.D08.1.454.CMB.1.raw
  modified_base (127)..(127): a, c, t, g, unknown or other
  misc_feature (127)..(127): n is a, c, g, or t

SEQ ID NO: 273533 - DNA, 127 bp, Homo sapiens; identical to SEQ ID NO: 273495
  misc_feature: GYAE6OF01C75JP.49.41.D08.1.454.CMB.1.raw
  modified_base (127)..(127): a, c, t, g, unknown or other
  misc_feature (127)..(127): n is a, c, g, or t

SEQ ID NO: 273534 - DNA, 145 bp, Homo sapiens
  misc_feature: GYAE6OF01CB9G1.49.41.D08.1.454.CMB.1.raw
  modified_base (121)..(121): a, c, t, g, unknown or other
  misc_feature (121)..(121): n is a, c, g, or t
  modified_base (127)..(145): a, c, t, g, unknown or other
  misc_feature (127)..(145): n is a, c, g, or t
tcagagtcgagagacacgaccggtgctcgatttagtcacgcgagaaagggaaggggcgtggccctgacgtgtttctgttcccgccctcctctctctcgactctgagcgggctggcaaggcncatagnnnnnnnnnnnnnnnnnnn

SEQ ID NO: 273535 - DNA, 127 bp, Homo sapiens; identical to SEQ ID NO: 273495
  misc_feature: GYAE6OF01AYTV2.49.41.D08.1.454.CMB.1.raw
  modified_base (127)..(127): a, c, t, g, unknown or other
  misc_feature (127)..(127): n is a, c, g, or t

SEQ ID NO: 273536 - DNA, 127 bp, Homo sapiens; identical to SEQ ID NO: 273495
  misc_feature: GYAE6OF01DAQG2.49.41.D08.1.454.CMB.1.raw
  modified_base (127)..(127): a, c, t, g, unknown or other
  misc_feature (127)..(127): n is a, c, g, or t

SEQ ID NO: 273537 - DNA, 130 bp, Homo sapiens
  misc_feature: GYAE6OF01EYGIG.49.41.D08.1.454.CMB.1.raw
  modified_base (128)..(130): a, c, t, g, unknown or other
  misc_feature (128)..(130): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgccatagnnn

SEQ ID NO: 273538 - DNA, 125 bp, Homo sapiens
  misc_feature: GYAE6OF01BHI74.49.41.D08.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaaagggaaggggctggccctgacgtgtttctgttcccgcctcctctctctcgactctgagcgggctggcaaggcgcatagn

SEQ ID NO: 273539 - DNA, 127 bp, Homo sapiens; identical to SEQ ID NO: 273495
  misc_feature: GYAE6OF01D8TDV.49.41.D08.1.454.CMB.1.raw
  modified_base (127)..(127): a, c, t, g, unknown or other
  misc_feature (127)..(127): n is a, c, g, or t

SEQ ID NO: 273540 - DNA, 127 bp, Homo sapiens; identical to SEQ ID NO: 273495
  misc_feature: GYAE6OF01ERFDC.49.41.D08.1.454.CMB.1.raw
  modified_base (127)..(127): a, c, t, g, unknown or other
  misc_feature (127)..(127): n is a, c, g, or t

SEQ ID NO: 273541 - DNA, 141 bp, Homo sapiens
  misc_feature: GYAE6OF01CWFEI.49.41.D08.1.454.CMB.1.raw
  modified_base (120)..(120): a, c, t, g, unknown or other
  misc_feature (120)..(120): n is a, c, g, or t
  modified_base (126)..(141): a, c, t, g, unknown or other
  misc_feature (126)..(141): n is a, c, g, or t
tcagagtcgagagacacgaccggtgctcgatttagtcacgcgagaaagggaaagggctggccctgacgtgtttctgttcccaccctcctctctctcgactctgagcgggctggcaaggcncatagnnnnnnnnnnnnnnnn

SEQ ID NO: 273542 - DNA, 127 bp, Homo sapiens; identical to SEQ ID NO: 273495
  misc_feature: GYAE6OF01BBXTG.49.41.D08.1.454.CMB.1.raw
  modified_base (127)..(127): a, c, t, g, unknown or other
  misc_feature (127)..(127): n is a, c, g, or t

SEQ ID NO: 273543 - DNA, 161 bp, Homo sapiens
  misc_feature: GYAE6OF01AZPAX.49.41.D08.1.454.CMB.1.raw
  modified_base (161)..(161): a, c, t, g, unknown or other
  misc_feature (161)..(161): n is a, c, g, or t
tcagagtcgagagacacgaccggtgctcgatttagtcacgcgagaaagggaaaggggtgctcgatttagtcacgcgagaaagggaaaggggctggccctgacgtgtttctgttcccgccctcctctctctcgactctgagcgggctggcaaggcgcatagn

SEQ ID NO: 273544 - DNA, 130 bp, Homo sapiens
  misc_feature: GYAE6OF01AYVZB.49.41.D08.1.454.CMB.1.raw
  modified_base (128)..(130): a, c, t, g, unknown or other
  misc_feature (128)..(130): n is a, c, g, or t
tcagagtcgagagacacgaccggtgctcgatttagtcacgcgagaaagggaaaggggctgggccctgacgtgtttctgttcccaccctcctctctctcgactctgagcgggctggcaaggcgcatagnnn

SEQ ID NO: 273545 - DNA, 126 bp, Homo sapiens
  misc_feature: GYAE6OF01DKPJW.49.41.D08.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaaagggaaaggggccggccctgacgtgtttctgttcccaccctcctctctctcgactctgagcggctggcaaggcgcatagn

SEQ ID NO: 273546 - DNA, 127 bp, Homo sapiens; identical to SEQ ID NO: 273495
  misc_feature: GYAE6OF01E5XFG.49.41.D08.1.454.CMB.1.raw
  modified_base (127)..(127): a, c, t, g, unknown or other
  misc_feature (127)..(127): n is a, c, g, or t

SEQ ID NO: 273547 - DNA, 127 bp, Homo sapiens; identical to SEQ ID NO: 273495
  misc_feature: GYAE6OF01AXXOM.49.41.D08.1.454.CMB.1.raw
  modified_base (127)..(127): a, c, t, g, unknown or other
  misc_feature (127)..(127): n is a, c, g, or t

SEQ ID NO: 273548 - DNA, 106 bp, Homo sapiens
  misc_feature: GYAE6OF01DZLGA.49.41.D08.1.454.CMB.1.raw
tcagagtcgagagacacgaccggtgctcgatttagtcacgcgagaaagggaaagggcaagcagaagacggcatacgagatcctgagcgggctggcaaggcgcatag

SEQ ID NO: 273549 - DNA, 127 bp, Homo sapiens; identical to SEQ ID NO: 273495
  misc_feature: GYAE6OF01BDV6Q.49.41.D08.1.454.CMB.1.raw
  modified_base (127)..(127): a, c, t, g, unknown or other
  misc_feature (127)..(127): n is a, c, g, or t

SEQ ID NO: 273550 - DNA, 130 bp, Homo sapiens
  misc_feature: GYAE6OF01DQGM3.49.41.D08.1.454.CMB.1.raw
  modified_base (128)..(130): a, c, t, g, unknown or other
  misc_feature (128)..(130): n is a, c, g, or t
tcagagtcgagagacacgaccggtgctcgatttagtcacgcgagaaagggaaagggggctggccctgacgtgtttctgttcccgccctcctctctctcgactctgagcgggctggcaaggcgcatagnnn

SEQ ID NO: 273551 - DNA, 127 bp, Homo sapiens; identical to SEQ ID NO: 273487
  misc_feature: GYAE6OF01A10MV.49.41.D08.1.454.CMB.1.raw
  modified_base (127)..(127): a, c, t, g, unknown or other
  misc_feature (127)..(127): n is a, c, g, or t

SEQ ID NO: 273552 - DNA, 127 bp, Homo sapiens; identical to SEQ ID NO: 273487
  misc_feature: GYAE6OF01EV9NX.49.41.D08.1.454.CMB.1.raw
  modified_base (127)..(127): a, c, t, g, unknown or other
  misc_feature (127)..(127): n is a, c, g, or t

SEQ ID NO: 273553 - DNA, 127 bp, Homo sapiens; identical to SEQ ID NO: 273487
  misc_feature: GYAE6OF01D0UKR.49.41.D08.1.454.CMB.1.raw
  modified_base (127)..(127): a, c, t, g, unknown or other
  misc_feature (127)..(127): n is a, c, g, or t

SEQ ID NO: 273554 - DNA, 168 bp, Homo sapiens
  misc_feature: GYAE6OF01BM0UN.49.41.D08.1.454.CMB.1.raw
  modified_base (129)..(168): a, c, t, g, unknown or other
  misc_feature (129)..(168): n is a, c, g, or t
tcagagtcgagagacacgaccggtgctcgatttagtcacgcgagaaagggaaagggcgtggtccctgacgtgtttctgttcccaccctcctctctctcgactctagagcgggctggcaaggcgcatagnnnnnnnnnnnnnnnnnnnnnnnnnnnnnnnnnnnnnnnn

SEQ ID NO: 273555 - DNA, 127 bp, Homo sapiens; identical to SEQ ID NO: 273495
  misc_feature: GYAE6OF01C6AJD.49.41.D08.1.454.CMB.1.raw
  modified_base (127)..(127): a, c, t, g, unknown or other
  misc_feature (127)..(127): n is a, c, g, or t

SEQ ID NO: 273556 - DNA, 126 bp, Homo sapiens; identical to SEQ ID NO: 273486
  misc_feature: GYAE6OF01B2ZZF.49.41.D08.1.454.CMB.1.raw
  modified_base (126)..(126): a, c, t, g, unknown or other
  misc_feature (126)..(126): n is a, c, g, or t

SEQ ID NO: 273557 - DNA, 126 bp, Homo sapiens; identical to SEQ ID NO: 273508
  misc_feature: GYAE6OF01EQ8Y5.49.41.D08.1.454.CMB.1.raw

SEQ ID NO: 273558 - DNA, 127 bp, Homo sapiens; identical to SEQ ID NO: 273495
  misc_feature: GYAE6OF01E0N1C.49.41.D08.1.454.CMB.1.raw
  modified_base (127)..(127): a, c, t, g, unknown or other
  misc_feature (127)..(127): n is a, c, g, or t

SEQ ID NO: 273559 - DNA, 126 bp, Homo sapiens
  misc_feature: GYAE6OF01BSRGX.49.41.D08.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaaagggaaaggggctggccctgacgtgtttctgttcccacctcctctctctcgactctgagcgggctggcaaggcgcatagn

SEQ ID NO: 273560 - DNA, 125 bp, Homo sapiens
  misc_feature: GYAE6OF01B424Q.49.41.D08.1.454.CMB.1.raw
tcagagtcgagagacacgaccggtgctcgatttagtcacgcgagaaagggaaagggctggccctgacgtgtttctgttcccgccctcctctctctcgactctgagcgggctggcaaggcgcatag

SEQ ID NO: 273561 - DNA, 183 bp, Homo sapiens
  misc_feature: GYAE6OF01E0QSR.49.41.D08.1.454.CMB.1.raw
  modified_base (75)..(75): a, c, t, g, unknown or other
  misc_feature (75)..(75): n is a, c, g, or t
  modified_base (119)..(119): a, c, t, g, unknown or other
  misc_feature (119)..(119): n is a, c, g, or t
  modified_base (125)..(183): a, c, t, g, unknown or other
  misc_feature (125)..(183): n is a, c, g, or t
tcagagtcgagagacacgaccggtgctcgatttagtcacgcgagaaagggaaggggctggccctgacgtgtttcngttcccacctcctctctctcgactctgagcgggctggcaaggcncatagnnnnnnnnnnnnnnnnnnnnnnnnnnnnnnnnnnnnnnnnnnnnnnnnnnnnnnnnnnn

SEQ ID NO: 273562 - DNA, 127 bp, Homo sapiens; identical to SEQ ID NO: 273495
  misc_feature: GYAE6OF01A3H0X.49.41.D08.1.454.CMB.1.raw
  modified_base (127)..(127): a, c, t, g, unknown or other
  misc_feature (127)..(127): n is a, c, g, or t

SEQ ID NO: 273563 - DNA, 121 bp, Homo sapiens
  misc_feature: GYAE6OF01DQWW7.49.41.D08.1.454.CMB.1.raw
  modified_base (120)..(121): a, c, t, g, unknown or other
  misc_feature (120)..(121): n is a, c, g, or t
tcagagtcgagagacacgaccggtgctcgatttagtcacgcgagaaagggaaagggctagcgtgttcctgttcccaccctcctctctctcgactctgagcgggctggcaaggcgcatagnn

SEQ ID NO: 273564 - DNA, 137 bp, Homo sapiens
  misc_feature: GYAE6OF01A0WMO.49.41.D08.1.454.CMB.1.raw
  modified_base (126)..(137): a, c, t, g, unknown or other
  misc_feature (126)..(137): n is a, c, g, or t
tcagagtcgagagacacgaccggtgctcgatttagtcacgcgagaaagggaagggggctggccctgacgtgtttctgttcccacctcctctctctcgactctgagcgggctggcaaggcgcatagnnnnnnnnnnnn

SEQ ID NO: 273565 - DNA, 129 bp, Homo sapiens
  misc_feature: GYAE6OF01EQAPW.49.41.D08.1.454.CMB.1.raw
  modified_base (128)..(129): a, c, t, g, unknown or other
  misc_feature (128)..(129): n is a, c, g, or t
tcagagtcgagagacacgaccggtgctcgatttagtcacgcgagaaagggaaaggggctgggccctgacgtgtttctgttcccgccctcctctctctcgactctgagcgggctggcaaggcgcatagnn

SEQ ID NO: 273566 - DNA, 127 bp, Homo sapiens; identical to SEQ ID NO: 273495
  misc_feature: GYAE6OF01DX7ND.49.41.D08.1.454.CMB.1.raw
  modified_base (127)..(127): a, c, t, g, unknown or other
  misc_feature (127)..(127): n is a, c, g, or t

SEQ ID NO: 273567 - DNA, 138 bp, Homo sapiens
  misc_feature: GYAE6OF01CH1J8.49.41.D08.1.454.CMB.1.raw
  modified_base (123)..(123): a, c, t, g, unknown or other
  misc_feature (123)..(123): n is a, c, g, or t
  modified_base (129)..(138): a, c, t, g, unknown or other
  misc_feature (129)..(138): n is a, c, g, or t
tcagagtcgagagacacgaccggtgctcgatttagtcacgcgagaaagggaagggggtcgtggccctgacgtgtttctgttcccaccctcctctctctcgactctgagcgggctggcaaggcncatagnnnnnnnnnn

SEQ ID NO: 273568 - DNA, 127 bp, Homo sapiens; identical to SEQ ID NO: 273495
  misc_feature: GYAE6OF01D3MSI.49.41.D08.1.454.CMB.1.raw
  modified_base (127)..(127): a, c, t, g, unknown or other
  misc_feature (127)..(127): n is a, c, g, or t

SEQ ID NO: 273569 - DNA, 127 bp, Homo sapiens; identical to SEQ ID NO: 273495
  misc_feature: GYAE6OF01DH5D3.49.41.D08.1.454.CMB.1.raw
  modified_base (127)..(127): a, c, t, g, unknown or other
  misc_feature (127)..(127): n is a, c, g, or t

SEQ ID NO: 273570 - DNA, 173 bp, Homo sapiens
  misc_feature: GYAE6OF01A850D.49.41.D08.1.454.CMB.1.raw
  modified_base (163)..(173): a, c, t, g, unknown or other
  misc_feature (163)..(173): n is a, c, g, or t
tcagagtcgagagacacgaccggtgctcgatttagtcacgcgagaaagggaaagggggtgctcgatttagtcacgcgagaaagggaaagggggctaggccctgacgtgtttctgttcccaccctcctctctctcgactctgagcggctggcaaggcgcatagnnnnnnnnnnn

SEQ ID NO: 273571 - DNA, 165 bp, Homo sapiens
  misc_feature: GYAE6OF01A33LE.49.41.D08.1.454.CMB.1.raw
  modified_base (122)..(122): a, c, t, g, unknown or other
  misc_feature (122)..(122): n is a, c, g, or t
  modified_base (129)..(165): a, c, t, g, unknown or other
  misc_feature (129)..(165): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcncagtagnnnnnnnnnnnnnnnnnnnnnnnnnnnnnnnnnnnnn

SEQ ID NO: 273572 - DNA, 127 bp, Homo sapiens; identical to SEQ ID NO: 273495
  misc_feature: GYAE6OF01CKU4K.49.41.D08.1.454.CMB.1.raw
  modified_base (127)..(127): a, c, t, g, unknown or other
  misc_feature (127)..(127): n is a, c, g, or t

SEQ ID NO: 273573 - DNA, 127 bp, Homo sapiens; identical to SEQ ID NO: 273487
  misc_feature: GYAE6OF01EXAOU.49.41.D08.1.454.CMB.1.raw
  modified_base (127)..(127): a, c, t, g, unknown or other
  misc_feature (127)..(127): n is a, c, g, or t

SEQ ID NO: 273574 - DNA, 127 bp, Homo sapiens
  misc_feature: GYAE6OF01B4PIZ.49.41.D08.1.454.CMB.1.raw
  modified_base (126)..(127): a, c, t, g, unknown or other
  misc_feature (126)..(127): n is a, c, g, or t
tcagagtcgagagacacgaccggtgctcgatttagtcacgcgagaaagggaaagggctggccctgacgtgtttctgttcccaccctcctctctctcgactctgagcgggctggcaaggcgcatagnn

SEQ ID NO: 273575 - DNA, 128 bp, Homo sapiens
  misc_feature: GYAE6OF01A62UQ.49.41.D08.1.454.CMB.1.raw
  modified_base (128)..(128): a, c, t, g, unknown or other
  misc_feature (128)..(128): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagn

SEQ ID NO: 273576 - DNA, 125 bp, Homo sapiens
  misc_feature: GYAE6OF01BE3T3.49.41.D08.1.454.CMB.1.raw
tcagagtcgagagacacgaccggtgctcgatttagtcacgcgagaaagggaaggggctggccctgacgtgtttctgttcccgccctcctctctctcgactctgagcgggctggcaaggcgcatag

SEQ ID NO: 273577 - DNA, 129 bp, Homo sapiens
  misc_feature: GYAE6OF01B1DBG.49.41.D08.1.454.CMB.1.raw
  modified_base (128)..(129): a, c, t, g, unknown or other
  misc_feature (128)..(129): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnn

SEQ ID NO: 273578 - DNA, 136 bp, Homo sapiens
  misc_feature: GYAE6OF01BGZRW.49.41.D08.1.454.CMB.1.raw
  modified_base (129)..(136): a, c, t, g, unknown or other
  misc_feature (129)..(136): n is a, c, g, or t
tcagagtcgagagacacgaccggtgctcgatttagtcacgcgagaaagggaaagggggctggccctgacgtgtttctgttcccaccctcctctctctcgactctggagcgggctggcaaggcgcatagnnnnnnnn

SEQ ID NO: 273579 - DNA, 159 bp, Homo sapiens
  misc_feature: GYAE6OF01EJJ1V.49.41.D08.1.454.CMB.1.raw
  modified_base (131)..(159): a, c, t, g, unknown or other
  misc_feature (131)..(159): n is a, c, g, or t
tcagagtcgagagacacgaccggtgctcgattttagtcacgcgagaaagggaaagggggcgtggccctgacgtgtttctgttcccaccctcctctctctcgactctgagcgggctggcaaggcgccatagnnnnnnnnnnnnnnnnnnnnnnnnnnnnn

SEQ ID NO: 273580 - DNA, 126 bp, Homo sapiens; identical to SEQ ID NO: 273508
  misc_feature: GYAE6OF01AGH0J.49.41.D08.1.454.CMB.1.raw

SEQ ID NO: 273581 - DNA, 161 bp, Homo sapiens
  misc_feature: GYAE6OF01B6YQV.49.41.D08.1.454.CMB.1.raw
tcagagtcgagagacacgaccggtgctcgatttagtcacgcgagaaagggaaagggggtgctcgatttagtcacgcgagaaagggaaaggggctggccctgacgtgtttctgttcccgccctcctctctctcgactctgagcgggctggcaaggcgcatag

SEQ ID NO: 273582 - DNA, 127 bp, Homo sapiens; identical to SEQ ID NO: 273487
  misc_feature: GYAE6OF01AOI6M.49.41.D08.1.454.CMB.1.raw
  modified_base (127)..(127): a, c, t, g, unknown or other
  misc_feature (127)..(127): n is a, c, g, or t

SEQ ID NO: 273583 - DNA, 127 bp, Homo sapiens; identical to SEQ ID NO: 273487
  misc_feature: GYAE6OF01BPKGQ.49.41.D08.1.454.CMB.1.raw
  modified_base (127)..(127): a, c, t, g, unknown or other
  misc_feature (127)..(127): n is a, c, g, or t

SEQ ID NO: 273584 - DNA, 132 bp, Homo sapiens
  misc_feature: GYAE6OF01AWB7K.49.41.D08.1.454.CMB.1.raw
  modified_base (124)..(132): a, c, t, g, unknown or other
  misc_feature (124)..(132): n is a, c, g, or t
tcagagtcgagagacacgaccggtgctcgatttagtcacgcgagaaagggaaagggctggccctgacgtgttctgttcccgcctcctctctctcgactctgagcgggctggcaaggcgcatagnnnnnnnnn

SEQ ID NO: 273585 - DNA, 128 bp, Homo sapiens
  misc_feature: GYAE6OF01E1H9C.49.41.D08.1.454.CMB.1.raw
  modified_base (128)..(128): a, c, t, g, unknown or other
  misc_feature (128)..(128): n is a, c, g, or t
tcagagtcgagagacacgaccggtgctcgatttagtcacgcgagaaagggaaagggggctggccctgacgtgtttctgttcccgccctcctctctctcgactctgagcgggctggcaaggcgcatagn

SEQ ID NO: 273586 - DNA, 128 bp, Homo sapiens; identical to SEQ ID NO: 273585
  misc_feature: GYAE6OF01D4HFP.49.41.D08.1.454.CMB.1.raw
  modified_base (128)..(128): a, c, t, g, unknown or other
  misc_feature (128)..(128): n is a, c, g, or t

SEQ ID NO: 273587 - DNA, 158 bp, Homo sapiens
  misc_feature: GYAE6OF01A0L0D.49.41.D08.1.454.CMB.1.raw
  modified_base (130)..(158): a, c, t, g, unknown or other
  misc_feature (130)..(158): n is a, c, g, or t
tcagagtcgagagacacgaccggtgctcgatttagtcacgcgagaaagggaagggggcgtggccctgacgtgtttcgtgttcccgccctcctctctctccgactctgagcgggctggcaaggcgcatagnnnnnnnnnnnnnnnnnnnnnnnnnnnnn

SEQ ID NO: 273588 - DNA, 128 bp, Homo sapiens
  misc_feature: GYAE6OF01BKG21.49.41.D08.1.454.CMB.1.raw
  modified_base (124)..(128): a, c, t, g, unknown or other
  misc_feature (124)..(128): n is a, c, g, or t
tcagagtcgagagacacgaccggtgctcgatttagtcacgcgagaaagggaaagggtggccctgacgtgtttctgttcccgccctcctctctctcgactctgagcggctggcaaggcgcatagnnnnn

SEQ ID NO: 273589 - DNA, 126 bp, Homo sapiens
  misc_feature: GYAE6OF01DK9JG.49.41.D08.1.454.CMB.1.raw
tcagagtcgagagacacgaccggtgctcgatttagtcacgcgagaaagggaaaggggctggccctgacgtgtttctgttcccaccctcctctctctcgactctgagcgggctggcaaggcgcatag

SEQ ID NO: 273590 - DNA, 127 bp, Homo sapiens; identical to SEQ ID NO: 273487
  misc_feature: GYAE6OF01ED9KR.49.41.D08.1.454.CMB.1.raw
  modified_base (127)..(127): a, c, t, g, unknown or other
  misc_feature (127)..(127): n is a, c, g, or t

SEQ ID NO: 273591 - DNA, 125 bp, Homo sapiens; identical to SEQ ID NO: 273520
  misc_feature: GYAE6OF01D07TT.49.41.D08.1.454.CMB.1.raw

SEQ ID NO: 273592 - DNA, 173 bp, Homo sapiens
  misc_feature: GYAE6OF01EWU9M.49.41.D08.1.454.CMB.1.raw
  modified_base (130)..(132): a, c, t, g, unknown or other
  misc_feature (130)..(132): n is a, c, g, or t
  modified_base (134)..(173): a, c, t, g, unknown or other
  misc_feature (134)..(173): n is a, c, g, or t
tcagagtcgagagacacgaccggtgctcgattttagtcacgcgagaaagggaaagggggctggccctgacgtgtttctgttcccaccctcctctctctcgactctgagcgggctggcaaggcgccatagnnngnnnnnnnnnnnnnnnnnnnnnnnnnnnnnnnnnnnnnnnn

SEQ ID NO: 273593 - DNA, 127 bp, Homo sapiens; identical to SEQ ID NO: 273495
  misc_feature: GYAE6OF01BDIWJ.49.41.D08.1.454.CMB.1.raw
  modified_base (127)..(127): a, c, t, g, unknown or other
  misc_feature (127)..(127): n is a, c, g, or t

SEQ ID NO: 273594 - DNA, 123 bp, Homo sapiens
  misc_feature: GYAE6OF01B2TK9.49.41.D08.1.454.CMB.1.raw
  modified_base (122)..(123): a, c, t, g, unknown or other
  misc_feature (122)..(123): n is a, c, g, or t
tcagagtcgagagacacgaccggtgctcgatttagtcacgcgagaaagggaaggtggccctgacgtgtttctgttcccaccctcctctctctcgactctgagcggctggcaaggcgcatagnn

SEQ ID NO: 273595 - DNA, 127 bp, Homo sapiens; identical to SEQ ID NO: 273487
  misc_feature: GYAE6OF01AFYNR.49.41.D08.1.454.CMB.1.raw
  modified_base (127)..(127): a, c, t, g, unknown or other
  misc_feature (127)..(127): n is a, c, g, or t

SEQ ID NO: 273596 - DNA, 128 bp, Homo sapiens
  misc_feature: GYAE6OF01DL0CK.49.41.D08.1.454.CMB.1.raw
  modified_base (127)..(128): a, c, t, g, unknown or other
  misc_feature (127)..(128): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgcatagnn

SEQ ID NO: 273597 - DNA, 141 bp, Homo sapiens
  misc_feature: GYAE6OF01BT7QR.49.41.D08.1.454.CMB.1.raw
  modified_base (125)..(141): a, c, t, g, unknown or other
  misc_feature (125)..(141): n is a, c, g, or t
tcagagtcgagagacacgaccggtgctcgatttagtcacgcgagaaagggaagggctggccctgacgtgtttctgttcccgccctcctctctctcgactctgagcgggctggcaaggcgcatagnnnnnnnnnnnnnnnnn

SEQ ID NO: 273598 - DNA, 131 bp, Homo sapiens
  misc_feature: GYAE6OF01B078C.49.41.D08.1.454.CMB.1.raw
  modified_base (128)..(131): a, c, t, g, unknown or other
  misc_feature (128)..(131): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnn

SEQ ID NO: 273599 - DNA, 127 bp, Homo sapiens; identical to SEQ ID NO: 273495
  misc_feature: GYAE6OF01DI9J7.49.41.D08.1.454.CMB.1.raw
  modified_base (127)..(127): a, c, t, g, unknown or other
  misc_feature (127)..(127): n is a, c, g, or t

SEQ ID NO: 273600 - DNA, 128 bp, Homo sapiens; identical to SEQ ID NO: 273596
  misc_feature: GYAE6OF01BDR8X.49.41.D08.1.454.CMB.1.raw
  modified_base (127)..(128): a, c, t, g, unknown or other
  misc_feature (127)..(128): n is a, c, g, or t

SEQ ID NO: 273601 - DNA, 127 bp, Homo sapiens; identical to SEQ ID NO: 273487
  misc_feature: GYAE6OF01A2MOU.49.41.D08.1.454.CMB.1.raw
  modified_base (127)..(127): a, c, t, g, unknown or other
  misc_feature (127)..(127): n is a, c, g, or t

SEQ ID NO: 273602 - DNA, 126 bp, Homo sapiens
  misc_feature: GYAE6OF01A2KHF.49.41.D08.1.454.CMB.1.raw
  modified_base (123)..(126): a, c, t, g, unknown or other
  misc_feature (123)..(126): n is a, c, g, or t
tcagagtcgagagacacgaccggtgctcgatttagtcacgcgagaaagggaaggctggccctgacgtgtttctgttcccacctcctctctctcgactctgagcgggctggcaaggcgcatagnnnn

SEQ ID NO: 273603 - DNA, 126 bp, Homo sapiens; identical to SEQ ID NO: 273589
  misc_feature: GYAE6OF01C8K88.49.41.D08.1.454.CMB.1.raw

SEQ ID NO: 273604 - DNA, 127 bp, Homo sapiens; identical to SEQ ID NO: 273495
  misc_feature: GYAE6OF01DC11E.49.41.D08.1.454.CMB.1.raw
  modified_base (127)..(127): a, c, t, g, unknown or other
  misc_feature (127)..(127): n is a, c, g, or t

SEQ ID NO: 273605 - DNA, 126 bp, Homo sapiens
  misc_feature: GYAE6OF01E3QEJ.49.41.D08.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaaagggaaagggctggccctgacgtgtttctgttcccaccctcctctctctcgactctgagcgggctggcaaggcgcatagn

SEQ ID NO: 273606 - DNA, 126 bp, Homo sapiens
  misc_feature: GYAE6OF01CATTB.49.41.D08.1.454.CMB.1.raw
  modified_base (123)..(126): a, c, t, g, unknown or other
  misc_feature (123)..(126): n is a, c, g, or t
tcagagtcgagagacacgaccggtgctcgatttagtcacgcgagaaagggaagggtgccctgacgtgtttctgttcccaccctcctctctctcgactctgagcgggctggcaaggcgcatagnnnn

SEQ ID NO: 273607 - DNA, 128 bp, Homo sapiens
  misc_feature: GYAE6OF01B2ZVU.49.41.D08.1.454.CMB.1.raw
  modified_base (120)..(120): a, c, t, g, unknown or other
  misc_feature (120)..(120): n is a, c, g, or t
  modified_base (126)..(128): a, c, t, g, unknown or other
  misc_feature (126)..(128): n is a, c, g, or t
tcagagtcgagagacacgaccggtgctcgatttagtcacgcgagaaagggaaggggctggccctgacgtgtttctgttcccaccctcctctctctcgactctgagcgggctggcaaggcncatagnnn

SEQ ID NO: 273608 - DNA, 132 bp, Homo sapiens
  misc_feature: GYAE6OF01B3RFZ.49.41.D08.1.454.CMB.1.raw
  modified_base (128)..(132): a, c, t, g, unknown or other
  misc_feature (128)..(132): n is a, c, g, or t
tcagagtcgagagacacgaccggtgctcgatttagtcacgcgagaaagggaaagggggctggccctgacgtgtttctgttcccgccctcctctctctcgactctgagcgggctggcaaggcgcatagnnnnn

SEQ ID NO: 273609 - DNA, 161 bp, Homo sapiens
  misc_feature: GYAE6OF01CQ6S9.49.41.D08.1.454.CMB.1.raw
  modified_base (159)..(161): a, c, t, g, unknown or other
  misc_feature (159)..(161): n is a, c, g, or t
tcagagtcgagagacacgaccggtgctcgatttagtcacgcgagaaagggaaagggggtgctcgatttagtcacgcgagaaagggaagggtggccctgacgtgtttctgttcccgccctcctctctctcgactctgagcgggctggcaaggcgcatagnnn

SEQ ID NO: 273610 - DNA, 129 bp, Homo sapiens; identical to SEQ ID NO: 273577
  misc_feature: GYAE6OF01BXLAZ.49.41.D08.1.454.CMB.1.raw
  modified_base (128)..(129): a, c, t, g, unknown or other
  misc_feature (128)..(129): n is a, c, g, or t

SEQ ID NO: 273611 - DNA, 156 bp, Homo sapiens
  misc_feature: GYAE6OF01ED1V4.49.41.D08.1.454.CMB.1.raw
  modified_base (75)..(75): a, c, t, g, unknown or other
  misc_feature (75)..(75): n is a, c, g, or t
  modified_base (121)..(121): a, c, t, g, unknown or other
  misc_feature (121)..(121): n is a, c, g, or t
  modified_base (127)..(156): a, c, t, g, unknown or other
  misc_feature (127)..(156): n is a, c, g, or t
tcagagtcgagagacacgaccggtgctcgatttagtcacgcgagaaagggaaggggctggccctgacgtgtttcngttcccgccctcctctctctcgactctgagcgggctaggcaaggcncatagnnnnnnnnnnnnnnnnnnnnnnnnnnnnnn

SEQ ID NO: 273612 - DNA, 131 bp, Homo sapiens
  misc_feature: GYAE6OF01D0LB5.49.41.D08.1.454.CMB.1.raw
  modified_base (122)..(122): a, c, t, g, unknown or other
  misc_feature (122)..(122): n is a, c, g, or t
  modified_base (128)..(131): a, c, t, g, unknown or other
  misc_feature (128)..(131): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcncatagnnnn

SEQ ID NO: 273613 - DNA, 127 bp, Homo sapiens
  misc_feature: GYAE6OF01B4VO5.49.41.D08.1.454.CMB.1.raw
tcagagtcgagagacacgaccggtgctcgatttagtcacgcgagaaagggaaagggggctggccctgacgtgtttctgttcccaccctcctctctctcgactctgagcgggctggcaaggcgcatag

SEQ ID NO: 273614 - DNA, 143 bp, Homo sapiens
  misc_feature: GYAE6OF01AS3VZ.49.41.D08.1.454.CMB.1.raw
  modified_base (128)..(143): a, c, t, g, unknown or other
  misc_feature (128)..(143): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggccgcatagnnnnnnnnnnnnnnnn

SEQ ID NO: 273615 - DNA, 168 bp, Homo sapiens
  misc_feature: GYAE6OF01CJTYD.49.41.D08.1.454.CMB.1.raw
  modified_base (129)..(168): a, c, t, g, unknown or other
  misc_feature (129)..(168): n is a, c, g, or t
tcagagtcgagagacacgaccggtgctcgatttagtcacgcgagaaagggaaagggggcgtggccctgacgtgtttctgttcccaccctcctctctctcgactctgagcgggctggcaaggcgcatagnnnnnnnnnnnnnnnnnnnnnnnnnnnnnnnnnnnnnnnn

SEQ ID NO: 273616 - DNA, 170 bp, Homo sapiens
  misc_feature: GYAE6OF01BPMIA.49.41.D08.1.454.CMB.1.raw
  modified_base (163)..(170): a, c, t, g, unknown or other
  misc_feature (163)..(170): n is a, c, g, or t
tcagagtcgagagacacgaccggtgctcgatttagtcacgcgagaaagggaaagggggtgctcgatttagtcacgcgagaaagggaaagggggctggccctgacgtgtttctgttcccgccctcctctctctcgactctgagcgggctggcaaggcgcatagnnnnnnnn

SEQ ID NO: 273617 - DNA, 595 bp, Homo sapiens
  misc_feature: GYAE6OF01BAITI.49.41.D08.1.454.CMB.1.raw
  modified_base (123)..(123): a, c, t, g, unknown or other
  misc_feature (123)..(123): n is a, c, g, or t
  modified_base (129)..(130): a, c, t, g, unknown or other
  misc_feature (129)..(130): n is a, c, g, or t
  modified_base (132)..(136): a, c, t, g, unknown or other
  misc_feature (132)..(136): n is a, c, g, or t
  modified_base (138)..(138): a, c, t, g, unknown or other
  misc_feature (138)..(138): n is a, c, g, or t
  modified_base (145)..(145): a, c, t, g, unknown or other
  misc_feature (145)..(145): n is a, c, g, or t
  modified_base (157)..(157): a, c, t, g, unknown or other
  misc_feature (157)..(157): n is a, c, g, or t
  modified_base (159)..(159): a, c, t, g, unknown or other
  misc_feature (159)..(159): n is a, c, g, or t
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (169)..(169): a, c, t, g, unknown or other
  misc_feature (169)..(169): n is a, c, g, or t
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
tcagagtcgagagacacgaccggtgctcgattttagtcacgcgagaaagggaaagggggctggccctgacgtgtttctgttcccaccctcctctctctcgactctgagcgggctggcaaggcncatagnntnnnnngnctgcatntgatctcagtgntnccgngatncnctgctntgcnggttntcnctncgccggtnacgntcncgagngcngttgcgtcgctaaagctttggaacgttggccgaaacncgacgggacgngtacgtcgcgcgtcgtcgtgtacgtacgacgtgtgtacggtcgtcgtacgacgtactacgtacgtacgtacgtacgtacgtacgtacgtacgtacgtacgtacgtacgacgtacgtacgtacgtacgtacgtacgtacgtacgtacgtcgtacgtacgtaacgtacgtacgtactacgtacgtacgtacgtacgtacgtacgtacgtacgtacgtacgtacgtacgtacgtacgtacgtacgtacgtacgtacgtacgtaccgtacgtacgtacgtacggtacgtagtacggtacggtacgtacgttacgtcgtacgtacgtcgtcgtcgtacg

SEQ ID NO: 273618 - DNA, 136 bp, Homo sapiens
  misc_feature: GYAE6OF01D3DTR.49.41.D08.1.454.CMB.1.raw
  modified_base (128)..(136): a, c, t, g, unknown or other
  misc_feature (128)..(136): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnnnnnnn

SEQ ID NO: 273619 - DNA, 128 bp, Homo sapiens; identical to SEQ ID NO: 273596
  misc_feature: GYAE6OF01C2BDB.49.41.D08.1.454.CMB.1.raw
  modified_base (127)..(128): a, c, t, g, unknown or other
  misc_feature (127)..(128): n is a, c, g, or t

SEQ ID NO: 273620 - DNA, 139 bp, Homo sapiens
  misc_feature: GYAE6OF01CGEQE.49.41.D08.1.454.CMB.1.raw
  modified_base (125)..(139): a, c, t, g, unknown or other
  misc_feature (125)..(139): n is a, c, g, or t
tcagagtcgagagacacgaccggtgctcgatttagtcacgcgagaaagggaaggggctggccctgacgtgtttctgttcccaccctctctctctcgactctgagcgggctggcaaggcgcatagnnnnnnnnnnnnnnn

SEQ ID NO: 273621 - DNA, 165 bp, Homo sapiens
  misc_feature: GYAE6OF01AR80Q.49.41.D08.1.454.CMB.1.raw
  modified_base (122)..(122): a, c, t, g, unknown or other
  misc_feature (122)..(122): n is a, c, g, or t
  modified_base (128)..(165): a, c, t, g, unknown or other
  misc_feature (128)..(165): n is a, c, g, or t
tcagagtcgagagacacgaccggtgctcgatttagtcacgcgagaaagggaaaggggctggccctgacgtgtttctgttcccaccctcctctctctcgactctgagcgggctggacaaggcncatagnnnnnnnnnnnnnnnnnnnnnnnnnnnnnnnnnnnnnn

SEQ ID NO: 273622 - DNA, 144 bp, Homo sapiens
  misc_feature: GYAE6OF01BKCYY.49.41.D08.1.454.CMB.1.raw
  modified_base (129)..(144): a, c, t, g, unknown or other
  misc_feature (129)..(144): n is a, c, g, or t
tcagagtcgagagacacgaccggtgctcgatttagtcacgcgagaaagggaaagggggctggccctgacgtgtttctgttcccaccctcctctctctccgactctgagcgggctggcaaggcgcatagnnnnnnnnnnnnnnnn

SEQ ID NO: 273623 - DNA, 158 bp, Homo sapiens
  misc_feature: GYAE6OF01BX0YN.49.41.D08.1.454.CMB.1.raw
  modified_base (128)..(158): a, c, t, g, unknown or other
  misc_feature (128)..(158): n is a, c, g, or t
tcagagtcgagagacacgaccggtgctcgatttagtcacgcgagaaagggaagggggctggccctgacgtgtttctgttcccacctcctctctctcgactctgagcgggctggacaaggcgcataggnnnnnnnnnnnnnnnnnnnnnnnnnnnnnnn

SEQ ID NO: 273624 - DNA, 126 bp, Homo sapiens; identical to SEQ ID NO: 273486
  misc_feature: GYAE6OF02FHBIN.49.41.D08.1.454.CMB.1.raw
  modified_base (126)..(126): a, c, t, g, unknown or other
  misc_feature (126)..(126): n is a, c, g, or t

SEQ ID NO: 273625 - DNA, 125 bp, Homo sapiens; identical to SEQ ID NO: 273538
  misc_feature: GYAE6OF02F5KHT.49.41.D08.1.454.CMB.1.raw
  modified_base (125)..(125): a, c, t, g, unknown or other
  misc_feature (125)..(125): n is a, c, g, or t

SEQ ID NO: 273626 - DNA, 125 bp, Homo sapiens
  misc_feature: GYAE6OF02IBCA1.49.41.D08.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaaaggaaggggctggccctgacgtgtttctgttcccaccctcctctctctcgactctgagcgggctggcaaggcgcatagn

SEQ ID NO: 273627 - DNA, 126 bp, Homo sapiens; identical to SEQ ID NO: 273493
  misc_feature: GYAE6OF02GBC8H.49.41.D08.1.454.CMB.1.raw
  modified_base (126)..(126): a, c, t, g, unknown or other
  misc_feature (126)..(126): n is a, c, g, or t

SEQ ID NO: 273628 - DNA, 127 bp, Homo sapiens
  misc_feature: GYAE6OF02GJ85H.49.41.D08.1.454.CMB.1.raw
  modified_base (125)..(127): a, c, t, g, unknown or other
  misc_feature (125)..(127): n is a, c, g, or t
tcagagtcgagagacacgaccggtgctcgatttagtcacgcgagaaagggaaggggctggccctgacgtgtttctgttcccgcctcctctctctcgactctgagcgggctggcaaggcgcatagnnn

SEQ ID NO: 273629 - DNA, 139 bp, Homo sapiens
  misc_feature: GYAE6OF02HKMXN.49.41.D08.1.454.CMB.1.raw
  modified_base (126)..(139): a, c, t, g, unknown or other
  misc_feature (126)..(139): n is a, c, g, or t
tcagagtcgagagacacgaccggtgctcgatttagtcacgcgagaaagggaaagggctggcccgtgacgtgtttctgttcccgcctcctctctctcgactctgagcgggctggcaaggcgcatagnnnnnnnnnnnnnn

SEQ ID NO: 273630 - DNA, 127 bp, Homo sapiens; identical to SEQ ID NO: 273487
  misc_feature: GYAE6OF02GV78C.49.41.D08.1.454.CMB.1.raw
  modified_base (127)..(127): a, c, t, g, unknown or other
  misc_feature (127)..(127): n is a, c, g, or t

SEQ ID NO: 273631 - DNA, 125 bp, Homo sapiens
  misc_feature: GYAE6OF02HOVUQ.49.41.D08.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaaagggaaagggtggccctgacgtgtttctgttcccaccctcctctctctcgactctgagcgggctggcaaggcgcatagn

SEQ ID NO: 273632 - DNA, 127 bp, Homo sapiens
  misc_feature: GYAE6OF02G99DK.49.41.D08.1.454.CMB.1.raw
  modified_base (126)..(127): a, c, t, g, unknown or other
  misc_feature (126)..(127): n is a, c, g, or t
tcagagtcgagagacacgaccggtgctcgatttagtcacgcgagaaagggaaggggctggccctgacgtgtttctgttcccaccctcctctctctcgactctgagcgggctggcaaggcgcatagnn

SEQ ID NO: 273633 - DNA, 123 bp, Homo sapiens
  misc_feature: GYAE6OF02I6LRP.49.41.D08.1.454.CMB.1.raw
  modified_base (123)..(123): a, c, t, g, unknown or other
  misc_feature (123)..(123): n is a, c, g, or t
tcagagtcgagagacacgaccggtgctcgatttagtcacgcgagaaaggaaggggctggccctgacgtgtttctgttccacctcctctctctcgactctgagcgggctggcaaggcgcatagn

SEQ ID NO: 273634 - DNA, 156 bp, Homo sapiens
  misc_feature: GYAE6OF02IIWAQ.49.41.D08.1.454.CMB.1.raw
  modified_base (126)..(156): a, c, t, g, unknown or other
  misc_feature (126)..(156): n is a, c, g, or t
tcagagtcgagagacacgaccggtgctcgatttagtcacgcgagaaaggaaaggggctggccctgacgtgtttctgttcccaccctctctctctcgactctgagcggctggacaaggccgcatagnnnnnnnnnnnnnnnnnnnnnnnnnnnnnnn

SEQ ID NO: 273635 - DNA, 131 bp, Homo sapiens
  misc_feature: GYAE6OF02IPUBB.49.41.D08.1.454.CMB.1.raw
  modified_base (126)..(131): a, c, t, g, unknown or other
  misc_feature (126)..(131): n is a, c, g, or t
tcagagtcgagagacacgaccggtgctcgatttagtcacgcgagaaagggaaaggggctggccctgacgtgtttctgttcccacctcctctctctcgactctgagcgggctggcaaggcgcatagnnnnnn

SEQ ID NO: 273636 - DNA, 127 bp, Homo sapiens
  misc_feature: GYAE6OF02FZI0X.49.41.D08.1.454.CMB.1.raw
  modified_base (126)..(127): a, c, t, g, unknown or other
  misc_feature (126)..(127): n is a, c, g, or t
tcagagtcgagagacacgaccggtgctcgatttagtcacgcgagaaagggaaggggctggccctgacgtgtttctgttcccgccctcctctctctcgactctgagcgggctggcaaggcgcatagnn

SEQ ID NO: 273637 - DNA, 126 bp, Homo sapiens; identical to SEQ ID NO: 273493
  misc_feature: GYAE6OF02H3RNP.49.41.D08.1.454.CMB.1.raw
  modified_base (126)..(126): a, c, t, g, unknown or other
  misc_feature (126)..(126): n is a, c, g, or t

SEQ ID NO: 273638 - DNA, 134 bp, Homo sapiens
  misc_feature: GYAE6OF02IHIN3.49.41.D08.1.454.CMB.1.raw
  modified_base (128)..(134): a, c, t, g, unknown or other
  misc_feature (128)..(134): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnnnnn

SEQ ID NO: 273639 - DNA, 132 bp, Homo sapiens
  misc_feature: GYAE6OF02FSEFN.49.41.D08.1.454.CMB.1.raw
  modified_base (125)..(132): a, c, t, g, unknown or other
  misc_feature (125)..(132): n is a, c, g, or t
tcagagtcgagagacacgaccggtgctcgatttagtcacgcgagaaagggaaggggctggccctgacgtgtttctgttcccacctcctctctctcgactctgagcgggctggcaaggcgcatagnnnnnnnn

SEQ ID NO: 273640 - DNA, 125 bp, Homo sapiens
  misc_feature: GYAE6OF02HOC5V.49.41.D08.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaaagggaaggggctggccctgacgtgtttctgttcccacctcctctctctcgactctgagcgggctggcaaggcgcatagn

SEQ ID NO: 273641 - DNA, 126 bp, Homo sapiens; identical to SEQ ID NO: 273486
  misc_feature: GYAE6OF02H7NFN.49.41.D08.1.454.CMB.1.raw
  modified_base (126)..(126): a, c, t, g, unknown or other
  misc_feature (126)..(126): n is a, c, g, or t

SEQ ID NO: 273642 - DNA, 124 bp, Homo sapiens
  misc_feature: GYAE6OF02F7YBT.49.41.D08.1.454.CMB.1.raw
  modified_base (123)..(124): a, c, t, g, unknown or other
  misc_feature (123)..(124): n is a, c, g, or t
tcagagtcgagagacacgaccggtgctcgatttagtcacgcgagaaagggaaggtggccctgacgtgtttctgttcccgccctcctctctctcgactctgagcgggctggcaaggcgcatagnn

SEQ ID NO: 273643 - DNA, 124 bp, Homo sapiens
  misc_feature: GYAE6OF02GBRIN.49.41.D08.1.454.CMB.1.raw
  modified_base (124)..(124): a, c, t, g, unknown or other
  misc_feature (124)..(124): n is a, c, g, or t
tcagagtcgagagacacgaccggtgctcgatttagtcacgcgagaaagggaagggctggccctgacgtgtttctgttcccgcctcctctctctcgactctgagcgggctggcaaggcgcatagn

SEQ ID NO: 273644 - DNA, 127 bp, Homo sapiens; identical to SEQ ID NO: 273487
  misc_feature: GYAE6OF02GZE1H.49.41.D08.1.454.CMB.1.raw
  modified_base (127)..(127): a, c, t, g, unknown or other
  misc_feature (127)..(127): n is a, c, g, or t

SEQ ID NO: 273645 - DNA, 128 bp, Homo sapiens
  misc_feature: GYAE6OF02GVEJR.49.41.D08.1.454.CMB.1.raw
  modified_base (125)..(128): a, c, t, g, unknown or other
  misc_feature (125)..(128): n is a, c, g, or t
tcagagtcgagagacacgaccggtgctcgatttagtcacgcgagaaagggaaggggctggccctgacgtgtttctgttcccacctcctctctctcgactctgagcgggctggcaaggcgcatagnnnn

SEQ ID NO: 273646 - DNA, 127 bp, Homo sapiens; identical to SEQ ID NO: 273495
  misc_feature: GYAE6OF02GWMFD.49.41.D08.1.454.CMB.1.raw
  modified_base (127)..(127): a, c, t, g, unknown or other
  misc_feature (127)..(127): n is a, c, g, or t

SEQ ID NO: 273647 - DNA, 187 bp, Homo sapiens
  misc_feature: GYAE6OF02HELUX.49.41.D08.1.454.CMB.1.raw
  modified_base (132)..(187): a, c, t, g, unknown or other
  misc_feature (132)..(187): n is a, c, g, or t
tcagagtcgagagacacgaccggtgctcgatttagtcacgcgagaaagggaaaggggcgtggccctgaccgtgtttctggttcccgccctcctctctctcgactctgagcgggctggcaaggcgcataggcnnnnnnnnnnnnnnnnnnnnnnnnnnnnnnnnnnnnnnnnnnnnnnnnnnnnnnnn

SEQ ID NO: 273648 - DNA, 126 bp, Homo sapiens
  misc_feature: GYAE6OF02ICOAM.49.41.D08.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaaagggaaggggctggccctgacgtgtttctgttcccacctcctcctctctcgactctgagcgggctggcaaggcgcatagn

SEQ ID NO: 273649 - DNA, 126 bp, Homo sapiens; identical to SEQ ID NO: 273493
  misc_feature: GYAE6OF02GLBVW.49.41.D08.1.454.CMB.1.raw
  modified_base (126)..(126): a, c, t, g, unknown or other
  misc_feature (126)..(126): n is a, c, g, or t

SEQ ID NO: 273650 - DNA, 127 bp, Homo sapiens
  misc_feature: GYAE6OF02G0V7T.49.41.D08.1.454.CMB.1.raw
  modified_base (125)..(127): a, c, t, g, unknown or other
  misc_feature (125)..(127): n is a, c, g, or t
tcagagtcgagagacacgaccggtgctcgatttagtcacgcgagaaagggaaggggctggccctgacgtgtttctgttcccacctcctctctctcgactctgagcgggctggcaaggcgcatagnnn

SEQ ID NO: 273651 - DNA, 127 bp, Homo sapiens; identical to SEQ ID NO: 273495
  misc_feature: GYAE6OF02I9BLA.49.41.D08.1.454.CMB.1.raw
  modified_base (127)..(127): a, c, t, g, unknown or other
  misc_feature (127)..(127): n is a, c, g, or t

SEQ ID NO: 273652 - DNA, 129 bp, Homo sapiens
  misc_feature: GYAE6OF02IWIAH.49.41.D08.1.454.CMB.1.raw
  modified_base (126)..(129): a, c, t, g, unknown or other
  misc_feature (126)..(129): n is a, c, g, or t
tcagagtcgagagacacgaccggtgctcgatttagtcacgcgagaaagggaaaggggctggccctgacgtgtttctgttcccacctcctctctctcgactctgagcgggctggcaaggcgcatagnnnn

SEQ ID NO: 273653 - DNA, 127 bp, Homo sapiens; identical to SEQ ID NO: 273495
  misc_feature: GYAE6OF02IJ7NU.49.41.D08.1.454.CMB.1.raw
  modified_base (127)..(127): a, c, t, g, unknown or other
  misc_feature (127)..(127): n is a, c, g, or t

SEQ ID NO: 273654 - DNA, 143 bp, Homo sapiens
  misc_feature: GYAE6OF02GVRYX.49.41.D08.1.454.CMB.1.raw
  modified_base (127)..(143): a, c, t, g, unknown or other
  misc_feature (127)..(143): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgcatagnnnnnnnnnnnnnnnnn

SEQ ID NO: 273655 - DNA, 126 bp, Homo sapiens; identical to SEQ ID NO: 273508
  misc_feature: GYAE6OF02GVG2S.49.41.D08.1.454.CMB.1.raw

SEQ ID NO: 273656 - DNA, 126 bp, Homo sapiens; identical to SEQ ID NO: 273486
  misc_feature: GYAE6OF02FENOQ.49.41.D08.1.454.CMB.1.raw
  modified_base (126)..(126): a, c, t, g, unknown or other
  misc_feature (126)..(126): n is a, c, g, or t

SEQ ID NO: 273657 - DNA, 126 bp, Homo sapiens; identical to SEQ ID NO: 273486
  misc_feature: GYAE6OF02IBJLU.49.41.D08.1.454.CMB.1.raw
  modified_base (126)..(126): a, c, t, g, unknown or other
  misc_feature (126)..(126): n is a, c, g, or t

SEQ ID NO: 273658 - DNA, 126 bp, Homo sapiens; identical to SEQ ID NO: 273493
  misc_feature: GYAE6OF02GO5MA.49.41.D08.1.454.CMB.1.raw
  modified_base (126)..(126): a, c, t, g, unknown or other
  misc_feature (126)..(126): n is a, c, g, or t

SEQ ID NO: 273659 - DNA, 127 bp, Homo sapiens; identical to SEQ ID NO: 273495
  misc_feature: GYAE6OF02IS45M.49.41.D08.1.454.CMB.1.raw
  modified_base (127)..(127): a, c, t, g, unknown or other
  misc_feature (127)..(127): n is a, c, g, or t

SEQ ID NO: 273660 - DNA, 126 bp, Homo sapiens; identical to SEQ ID NO: 273486
  misc_feature: GYAE6OF02FSEEK.49.41.D08.1.454.CMB.1.raw
  modified_base (126)..(126): a, c, t, g, unknown or other
  misc_feature (126)..(126): n is a, c, g, or t

SEQ ID NO: 273661 - DNA, 129 bp, Homo sapiens
  misc_feature: GYAE6OF02G7254.49.41.D08.1.454.CMB.1.raw
  modified_base (129)..(129): a, c, t, g, unknown or other
  misc_feature (129)..(129): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgcataaagn

SEQ ID NO: 273662 - DNA, 135 bp, Homo sapiens
  misc_feature: GYAE6OF02H74LQ.49.41.D08.1.454.CMB.1.raw
  modified_base (129)..(135): a, c, t, g, unknown or other
  misc_feature (129)..(135): n is a, c, g, or t
tcagagtcgagagacacgaccggtgctcgatttagtcacgcgagaaagggaaagggggcgtggccctgacgtgtttctgttcccaccctcctctctctcgactctgagcgggctggcaaggcgcatagnnnnnnn

SEQ ID NO: 273663 - DNA, 127 bp, Homo sapiens; identical to SEQ ID NO: 273495
  misc_feature: GYAE6OF02F8V8A.49.41.D08.1.454.CMB.1.raw
  modified_base (127)..(127): a, c, t, g, unknown or other
  misc_feature (127)..(127): n is a, c, g, or t

SEQ ID NO: 273664 - DNA, 125 bp, Homo sapiens
  misc_feature: GYAE6OF02IF91F.49.41.D08.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaaagggaaggggctggccctgacgtgtttctgttcccgccctcctctctctcgactctgagcggctggcaaggcgcatagn

SEQ ID NO: 273665 - DNA, 126 bp, Homo sapiens; identical to SEQ ID NO: 273486
  misc_feature: GYAE6OF02FRVIY.49.41.D08.1.454.CMB.1.raw
  modified_base (126)..(126): a, c, t, g, unknown or other
  misc_feature (126)..(126): n is a, c, g, or t

SEQ ID NO: 273666 - DNA, 127 bp, Homo sapiens; identical to SEQ ID NO: 273495
  misc_feature: GYAE6OF02HSZXW.49.41.D08.1.454.CMB.1.raw
  modified_base (127)..(127): a, c, t, g, unknown or other
  misc_feature (127)..(127): n is a, c, g, or t

SEQ ID NO: 273667 - DNA, 125 bp, Homo sapiens; identical to SEQ ID NO: 273640
  misc_feature: GYAE6OF02FNAYE.49.41.D08.1.454.CMB.1.raw
  modified_base (125)..(125): a, c, t, g, unknown or other
  misc_feature (125)..(125): n is a, c, g, or t

SEQ ID NO: 273668 - DNA, 132 bp, Homo sapiens
  misc_feature: GYAE6OF02F9MM3.49.41.D08.1.454.CMB.1.raw
  modified_base (127)..(132): a, c, t, g, unknown or other
  misc_feature (127)..(132): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgcatagnnnnnn

SEQ ID NO: 273669 - DNA, 123 bp, Homo sapiens
  misc_feature: GYAE6OF02JFC0J.49.41.D08.1.454.CMB.1.raw
  modified_base (123)..(123): a, c, t, g, unknown or other
  misc_feature (123)..(123): n is a, c, g, or t
tcagagtcgagagacacgaccggtgctcgatttagtcacgcgagaaaggaagggctggccctgacgtgtttctgttcccacctcctctctctcgactctgagcgggctggcaaggcgcatagn

SEQ ID NO: 273670 - DNA, 126 bp, Homo sapiens; identical to SEQ ID NO: 273589
  misc_feature: GYAE6OF02GKH63.49.41.D08.1.454.CMB.1.raw

SEQ ID NO: 273671 - DNA, 127 bp, Homo sapiens; identical to SEQ ID NO: 273495
  misc_feature: GYAE6OF02HIVQR.49.41.D08.1.454.CMB.1.raw
  modified_base (127)..(127): a, c, t, g, unknown or other
  misc_feature (127)..(127): n is a, c, g, or t

SEQ ID NO: 273672 - DNA, 145 bp, Homo sapiens
  misc_feature: GYAE6OF02HRYFN.49.41.D08.1.454.CMB.1.raw
  modified_base (128)..(145): a, c, t, g, unknown or other
  misc_feature (128)..(145): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnnnnnnnnnnnnnnnn

SEQ ID NO: 273673 - DNA, 159 bp, Homo sapiens
  misc_feature: GYAE6OF02IHNAA.49.41.D08.1.454.CMB.1.raw
  modified_base (75)..(75): a, c, t, g, unknown or other
  misc_feature (75)..(75): n is a, c, g, or t
  modified_base (90)..(90): a, c, t, g, unknown or other
  misc_feature (90)..(90): n is a, c, g, or t
  modified_base (120)..(120): a, c, t, g, unknown or other
  misc_feature (120)..(120): n is a, c, g, or t
  modified_base (126)..(126): a, c, t, g, unknown or other
  misc_feature (126)..(126): n is a, c, g, or t
  modified_base (128)..(159): a, c, t, g, unknown or other
  misc_feature (128)..(159): n is a, c, g, or t
tcagagtcgagagacacgaccggtgctcgatttagtcacgcgagaaagggaaggggcgtgccctgacgtgtttcngttcccgccctcctntctctcgactctgagcgggctggcaaggcncatagncnnnnnnnnnnnnnnnnnnnnnnnnnnnnnnnn

SEQ ID NO: 273674 - DNA, 125 bp, Homo sapiens; identical to SEQ ID NO: 273626
  misc_feature: GYAE6OF02HNRIB.49.41.D08.1.454.CMB.1.raw
  modified_base (125)..(125): a, c, t, g, unknown or other
  misc_feature (125)..(125): n is a, c, g, or t

SEQ ID NO: 273675 - DNA, 127 bp, Homo sapiens; identical to SEQ ID NO: 273487
  misc_feature: GYAE6OF02GP6AP.49.41.D08.1.454.CMB.1.raw
  modified_base (127)..(127): a, c, t, g, unknown or other
  misc_feature (127)..(127): n is a, c, g, or t

SEQ ID NO: 273676 - DNA, 126 bp, Homo sapiens
  misc_feature: GYAE6OF02GKLP9.49.41.D08.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaaagggaaaggggctggccctgacgtgtttctgttcccaccctcctctctccgactctgagcgggctggcaaggcgcatagn

SEQ ID NO: 273677 - DNA, 127 bp, Homo sapiens; identical to SEQ ID NO: 273487
  misc_feature: GYAE6OF02H9O9B.49.41.D08.1.454.CMB.1.raw
  modified_base (127)..(127): a, c, t, g, unknown or other
  misc_feature (127)..(127): n is a, c, g, or t

SEQ ID NO: 273678 - DNA, 134 bp, Homo sapiens; identical to SEQ ID NO: 273638
  misc_feature: GYAE6OF02GYGIG.49.41.D08.1.454.CMB.1.raw
  modified_base (128)..(134): a, c, t, g, unknown or other
  misc_feature (128)..(134): n is a, c, g, or t

SEQ ID NO: 273679 - DNA, 151 bp, Homo sapiens
  misc_feature: GYAE6OF02FXEFE.49.41.D08.1.454.CMB.1.raw
  modified_base (126)..(151): a, c, t, g, unknown or other
  misc_feature (126)..(151): n is a, c, g, or t
tcagagtcgagagacacgaccggtgctcgatttagtcacgcgagaaagggaaggggctggccctgacgtgtttctgttcccaccctcctctctctcgactctgagcgggctggcaaggcgcatagnnnnnnnnnnnnnnnnnnnnnnnnnn

SEQ ID NO: 273680 - DNA, 127 bp, Homo sapiens; identical to SEQ ID NO: 273632
  misc_feature: GYAE6OF02H6HIT.49.41.D08.1.454.CMB.1.raw
  modified_base (126)..(127): a, c, t, g, unknown or other
  misc_feature (126)..(127): n is a, c, g, or t

SEQ ID NO: 273681 - DNA, 126 bp, Homo sapiens; identical to SEQ ID NO: 273486
  misc_feature: GYAE6OF02FIPMB.49.41.D08.1.454.CMB.1.raw
  modified_base (126)..(126): a, c, t, g, unknown or other
  misc_feature (126)..(126): n is a, c, g, or t

SEQ ID NO: 273682 - DNA, 127 bp, Homo sapiens; identical to SEQ ID NO: 273495
  misc_feature: GYAE6OF02HP0XA.49.41.D08.1.454.CMB.1.raw
  modified_base (127)..(127): a, c, t, g, unknown or other
  misc_feature (127)..(127): n is a, c, g, or t

SEQ ID NO: 273683 - DNA, 126 bp, Homo sapiens; identical to SEQ ID NO: 273486
  misc_feature: GYAE6OF02GKISH.49.41.D08.1.454.CMB.1.raw
  modified_base (126)..(126): a, c, t, g, unknown or other
  misc_feature (126)..(126): n is a, c, g, or t

SEQ ID NO: 273684 - DNA, 127 bp, Homo sapiens; identical to SEQ ID NO: 273487
  misc_feature: GYAE6OF02GMBKB.49.41.D08.1.454.CMB.1.raw
  modified_base (127)..(127): a, c, t, g, unknown or other
  misc_feature (127)..(127): n is a, c, g, or t

SEQ ID NO: 273685 - DNA, 126 bp, Homo sapiens
  misc_feature: GYAE6OF02HSALH.49.41.D08.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaaagggaaaggggctggccctgacgtgtttctgttcccaccctcctctctctcgctctgagcgggctggcaaggcgcatagn

SEQ ID NO: 273686 - DNA, 127 bp, Homo sapiens; identical to SEQ ID NO: 273495
  misc_feature: GYAE6OF02GWKHW.49.41.D08.1.454.CMB.1.raw
  modified_base (127)..(127): a, c, t, g, unknown or other
  misc_feature (127)..(127): n is a, c, g, or t

SEQ ID NO: 273687 - DNA, 127 bp, Homo sapiens; identical to SEQ ID NO: 273495
  misc_feature: GYAE6OF02FUJO9.49.41.D08.1.454.CMB.1.raw
  modified_base (127)..(127): a, c, t, g, unknown or other
  misc_feature (127)..(127): n is a, c, g, or t

SEQ ID NO: 273688 - DNA, 129 bp, Homo sapiens; identical to SEQ ID NO: 273577
  misc_feature: GYAE6OF02F6SSQ.49.41.D08.1.454.CMB.1.raw
  modified_base (128)..(129): a, c, t, g, unknown or other
  misc_feature (128)..(129): n is a, c, g, or t

SEQ ID NO: 273689 - DNA, 127 bp, Homo sapiens; identical to SEQ ID NO: 273632
  misc_feature: GYAE6OF02I92YL.49.41.D08.1.454.CMB.1.raw
  modified_base (126)..(127): a, c, t, g, unknown or other
  misc_feature (126)..(127): n is a, c, g, or t

SEQ ID NO: 273690 - DNA, 131 bp, Homo sapiens
  misc_feature: GYAE6OF02GM5KK.49.41.D08.1.454.CMB.1.raw
  modified_base (128)..(131): a, c, t, g, unknown or other
  misc_feature (128)..(131): n is a, c, g, or t
tcagagtcgagagacacgaccggtgctcgatttagtcacgcgagaaagggaaaggggctgggccctgacgtgtttctgttcccgccctcctctctctcgactctgagcgggctggcaaggcgcatagnnnn

SEQ ID NO: 273691 - DNA, 126 bp, Homo sapiens; identical to SEQ ID NO: 273493
  misc_feature: GYAE6OF02FSV1S.49.41.D08.1.454.CMB.1.raw
  modified_base (126)..(126): a, c, t, g, unknown or other
  misc_feature (126)..(126): n is a, c, g, or t

SEQ ID NO: 273692 - DNA, 127 bp, Homo sapiens; identical to SEQ ID NO: 273495
  misc_feature: GYAE6OF02GQPAO.49.41.D08.1.454.CMB.1.raw
  modified_base (127)..(127): a, c, t, g, unknown or other
  misc_feature (127)..(127): n is a, c, g, or t

SEQ ID NO: 273693 - DNA, 126 bp, Homo sapiens
  misc_feature: GYAE6OF02F2BGO.49.41.D08.1.454.CMB.1.raw
  modified_base (125)..(126): a, c, t, g, unknown or other
  misc_feature (125)..(126): n is a, c, g, or t
tcagagtcgagagacacgaccggtgctcgatttagtcacgcgagaaagggaaggggctggccctgacgtgtttctgttcccaccctcctctctctcactctgagcgggctggcaaggcgcatagnn

SEQ ID NO: 273694 - DNA, 128 bp, Homo sapiens; identical to SEQ ID NO: 273575
  misc_feature: GYAE6OF02IJIKI.49.41.D08.1.454.CMB.1.raw
  modified_base (128)..(128): a, c, t, g, unknown or other
  misc_feature (128)..(128): n is a, c, g, or t

SEQ ID NO: 273695 - DNA, 157 bp, Homo sapiens
  misc_feature: GYAE6OF02GU0F4.49.41.D08.1.454.CMB.1.raw
  modified_base (129)..(157): a, c, t, g, unknown or other
  misc_feature (129)..(157): n is a, c, g, or t
tcagagtcgagagacacgaccggtgctcgatttagtcacgcgagaaagggaaagggggcgtggccctgacgtgtttctgttcccaccctcctctctctcgactctgagcgggctggcaaggcgcatagnnnnnnnnnnnnnnnnnnnnnnnnnnnnn

SEQ ID NO: 273696 - DNA, 127 bp, Homo sapiens; identical to SEQ ID NO: 273495
  misc_feature: GYAE6OF02HX94R.49.41.D08.1.454.CMB.1.raw
  modified_base (127)..(127): a, c, t, g, unknown or other
  misc_feature (127)..(127): n is a, c, g, or t

SEQ ID NO: 273697 - DNA, 127 bp, Homo sapiens; identical to SEQ ID NO: 273487
  misc_feature: GYAE6OF02I2MZ2.49.41.D08.1.454.CMB.1.raw
  modified_base (127)..(127): a, c, t, g, unknown or other
  misc_feature (127)..(127): n is a, c, g, or t

SEQ ID NO: 273698 - DNA, 126 bp, Homo sapiens; identical to SEQ ID NO: 273508
  misc_feature: GYAE6OF02GSBT1.49.41.D08.1.454.CMB.1.raw

SEQ ID NO: 273699 - DNA, 154 bp, Homo sapiens
  misc_feature: GYAE6OF02F4HS1.49.41.D08.1.454.CMB.1.raw
  modified_base (129)..(154): a, c, t, g, unknown or other
  misc_feature (129)..(154): n is a, c, g, or t
tcagagtcgagagacacgaccggtgctcgatttagtcacgcgagaaagggaaagggggcgtggccctgacgtgtttctgttcccgccctcctctctctcgactctgagcgggctggcaaggcgcatagnnnnnnnnnnnnnnnnnnnnnnnnnn

SEQ ID NO: 273700 - DNA, 128 bp, Homo sapiens
  misc_feature: GYAE6OF02FGZIY.49.41.D08.1.454.CMB.1.raw
  modified_base (125)..(128): a, c, t, g, unknown or other
  misc_feature (125)..(128): n is a, c, g, or t
tcagagtcgagagacacgaccggtgctcgatttagtcacgcgagaaagggaaggggctggccctgacgtgtttctgttcccgcctcctctctctcgactctgagcgggctggcaaggcgcatagnnnn

SEQ ID NO: 273701 - DNA, 127 bp, Homo sapiens; identical to SEQ ID NO: 273495
  misc_feature: GYAE6OF02GD2ND.49.41.D08.1.454.CMB.1.raw
  modified_base (127)..(127): a, c, t, g, unknown or other
  misc_feature (127)..(127): n is a, c, g, or t

SEQ ID NO: 273702 - DNA, 127 bp, Homo sapiens; identical to SEQ ID NO: 273495
  misc_feature: GYAE6OF02H7Q6M.49.41.D08.1.454.CMB.1.raw
  modified_base (127)..(127): a, c, t, g, unknown or other
  misc_feature (127)..(127): n is a, c, g, or t

SEQ ID NO: 273703 - DNA, 127 bp, Homo sapiens; identical to SEQ ID NO: 273495
  misc_feature: GYAE6OF02I1LK7.49.41.D08.1.454.CMB.1.raw
  modified_base (127)..(127): a, c, t, g, unknown or other
  misc_feature (127)..(127): n is a, c, g, or t

SEQ ID NO: 273704 - DNA, 127 bp, Homo sapiens; identical to SEQ ID NO: 273495
  misc_feature: GYAE6OF02GUIA3.49.41.D08.1.454.CMB.1.raw
  modified_base (127)..(127): a, c, t, g, unknown or other
  misc_feature (127)..(127): n is a, c, g, or t

SEQ ID NO: 273705 - DNA, 128 bp, Homo sapiens; identical to SEQ ID NO: 273512
  misc_feature: GYAE6OF02G9DQV.49.41.D08.1.454.CMB.1.raw
  modified_base (127)..(128): a, c, t, g, unknown or other
  misc_feature (127)..(128): n is a, c, g, or t

SEQ ID NO: 273706 - DNA, 127 bp, Homo sapiens
  misc_feature: GYAE6OF02JVN7L.49.41.D08.1.454.CMB.1.raw
  modified_base (121)..(127): a, c, t, g, unknown or other
  misc_feature (121)..(127): n is a, c, g, or t
tcagagtcgagagacacgaccggtgctcgatttagtcacgcgagaaaggaaagggcgtggcctgacgtgttctgttccacctcctctctctcgactctgagcggctggcaaggcgcatagnnnnnnn

SEQ ID NO: 273707 - DNA, 125 bp, Homo sapiens; identical to SEQ ID NO: 273631
  misc_feature: GYAE6OF02IPZRH.49.41.D08.1.454.CMB.1.raw
  modified_base (125)..(125): a, c, t, g, unknown or other
  misc_feature (125)..(125): n is a, c, g, or t

SEQ ID NO: 273708 - DNA, 151 bp, Homo sapiens
  misc_feature: GYAE6OF02F4BJU.49.41.D08.1.454.CMB.1.raw
  modified_base (131)..(151): a, c, t, g, unknown or other
  misc_feature (131)..(151): n is a, c, g, or t
tcagagtcgagagacacgaccggtgctcgatttagtcacgcgagaaagggaaagggggctgggccctggacgtgtttctgttcccgccctcctctctctcgactctgagcgggctggcaaggcgcataggnnnnnnnnnnnnnnnnnnnnn

SEQ ID NO: 273709 - DNA, 128 bp, Homo sapiens; identical to SEQ ID NO: 273585
  misc_feature: GYAE6OF02IJU60.49.41.D08.1.454.CMB.1.raw
  modified_base (128)..(128): a, c, t, g, unknown or other
  misc_feature (128)..(128): n is a, c, g, or t

SEQ ID NO: 273710 - DNA, 127 bp, Homo sapiens; identical to SEQ ID NO: 273487
  misc_feature: GYAE6OF02H7SP0.49.41.D08.1.454.CMB.1.raw
  modified_base (127)..(127): a, c, t, g, unknown or other
  misc_feature (127)..(127): n is a, c, g, or t

SEQ ID NO: 273711 - DNA, 137 bp, Homo sapiens
  misc_feature: GYAE6OF02G1406.49.41.D08.1.454.CMB.1.raw
  modified_base (128)..(137): a, c, t, g, unknown or other
  misc_feature (128)..(137): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnnnnnnnn

SEQ ID NO: 273712 - DNA, 127 bp, Homo sapiens; identical to SEQ ID NO: 273495
  misc_feature: GYAE6OF02IORIP.49.41.D08.1.454.CMB.1.raw
  modified_base (127)..(127): a, c, t, g, unknown or other
  misc_feature (127)..(127): n is a, c, g, or t

SEQ ID NO: 273713 - DNA, 128 bp, Homo sapiens; identical to SEQ ID NO: 273512
  misc_feature: GYAE6OF02HESPI.49.41.D08.1.454.CMB.1.raw
  modified_base (127)..(128): a, c, t, g, unknown or other
  misc_feature (127)..(128): n is a, c, g, or t

SEQ ID NO: 273714 - DNA, 131 bp, Homo sapiens
  misc_feature: GYAE6OF02GPPRZ.49.41.D08.1.454.CMB.1.raw
  modified_base (127)..(131): a, c, t, g, unknown or other
  misc_feature (127)..(131): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggcgcatagnnnnn

SEQ ID NO: 273715 - DNA, 127 bp, Homo sapiens; identical to SEQ ID NO: 273487
  misc_feature: GYAE6OF02HKR2N.49.41.D08.1.454.CMB.1.raw
  modified_base (127)..(127): a, c, t, g, unknown or other
  misc_feature (127)..(127): n is a, c, g, or t

SEQ ID NO: 273716 - DNA, 127 bp, Homo sapiens; identical to SEQ ID NO: 273495
  misc_feature: GYAE6OF02IZ6V2.49.41.D08.1.454.CMB.1.raw
  modified_base (127)..(127): a, c, t, g, unknown or other
  misc_feature (127)..(127): n is a, c, g, or t

SEQ ID NO: 273717 - DNA, 129 bp, Homo sapiens
  misc_feature: GYAE6OF02G5CJT.49.41.D08.1.454.CMB.1.raw
  modified_base (126)..(129): a, c, t, g, unknown or other
  misc_feature (126)..(129): n is a, c, g, or t
tcagagtcgagagacacgaccggtgctcgatttagtcacgcgagaaagggaaggggctggccctgacgtgtttctgttcccaccctcctctctctcgactctgagcgggctggcaaggcgcatagnnnn

SEQ ID NO: 273718 - DNA, 128 bp, Homo sapiens; identical to SEQ ID NO: 273585
  misc_feature: GYAE6OF02H2WHJ.49.41.D08.1.454.CMB.1.raw
  modified_base (128)..(128): a, c, t, g, unknown or other
  misc_feature (128)..(128): n is a, c, g, or t

SEQ ID NO: 273719 - DNA, 129 bp, Homo sapiens
  misc_feature: GYAE6OF02HBM7W.49.41.D08.1.454.CMB.1.raw
  modified_base (126)..(129): a, c, t, g, unknown or other
  misc_feature (126)..(129): n is a, c, g, or t
tcagagtcgagagacacgaccggtgctcgatttagtcacgcgagaaagggaaaggggctggccctgacgtgtttctgttcccaccctcctctctccgactctgagcgggctggcaaggcgcatagnnnn

SEQ ID NO: 273720 - DNA, 126 bp, Homo sapiens
  misc_feature: GYAE6OF02FED17.49.41.D08.1.454.CMB.1.raw
tcagagtcgagagacacgaccggtgctcgatttagtcacgcgagaaagggaaggggcgtggccctgacgtgtttatgttcccgccctcctctctctcgactctgagcgggctggcaaggcgcatag

SEQ ID NO: 273721 - DNA, 127 bp, Homo sapiens
  misc_feature: GYAE6OF02H5N5J.49.41.D08.1.454.CMB.1.raw
  modified_base (126)..(127): a, c, t, g, unknown or other
  misc_feature (126)..(127): n is a, c, g, or t
tcagagtcgagagacacgaccggtgctcgatttagtcacgcgagaaagggaaaggggctggccctgacgtgtttctgttcccgccctcctctctctcgactctgagcggctggcaaggcgcatagnn

SEQ ID NO: 273722 - DNA, 151 bp, Homo sapiens
  misc_feature: GYAE6OF02FUBEQ.49.41.D08.1.454.CMB.1.raw
  modified_base (129)..(151): a, c, t, g, unknown or other
  misc_feature (129)..(151): n is a, c, g, or t
tcagagtcgagagacacgaccggtgctcgatttagtcacgcgagaaagggaaagggggcgtggccctgacgtgtttctgttcccaccctcctctctctcgactctgagcgggctggcaaggcgcatagnnnnnnnnnnnnnnnnnnnnnnn

SEQ ID NO: 273723 - DNA, 128 bp, Homo sapiens; identical to SEQ ID NO: 273575
  misc_feature: GYAE6OF02IU1CI.49.41.D08.1.454.CMB.1.raw
  modified_base (128)..(128): a, c, t, g, unknown or other
  misc_feature (128)..(128): n is a, c, g, or t

SEQ ID NO: 273724 - DNA, 143 bp, Homo sapiens
  misc_feature: GYAE6OF02HH289.49.41.D08.1.454.CMB.1.raw
  modified_base (128)..(143): a, c, t, g, unknown or other
  misc_feature (128)..(143): n is a, c, g, or t
tcagagtcgagagacacgaccggtgctcgatttagtcacgcgagaaagggaaaggggcgtggccctgacgtgtttctgttcccaccctcctctctctcgactctgagcgggctggcaaggcgcatagnnnnnnnnnnnnnnnn

SEQ ID NO: 273725 - DNA, 127 bp, Homo sapiens; identical to SEQ ID NO: 273495
  misc_feature: GYAE6OF02G8JMU.49.41.D08.1.454.CMB.1.raw
  modified_base (127)..(127): a, c, t, g, unknown or other
  misc_feature (127)..(127): n is a, c, g, or t

SEQ ID NO: 273726 - DNA, 127 bp, Homo sapiens; identical to SEQ ID NO: 273495
  misc_feature: GYAE6OF02IQ0ZZ.49.41.D08.1.454.CMB.1.raw
  modified_base (127)..(127): a, c, t, g, unknown or other
  misc_feature (127)..(127): n is a, c, g, or t

SEQ ID NO: 273727 - DNA, 165 bp, Homo sapiens
  misc_feature: GYAE6OF02HCUGQ.49.41.D08.1.454.CMB.1.raw
  modified_base (127)..(129): a, c, t, g, unknown or other
  misc_feature (127)..(129): n is a, c, g, or t
  modified_base (131)..(165): a, c, t, g, unknown or other
  misc_feature (131)..(165): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgcatagnnngnnnnnnnnnnnnnnnnnnnnnnnnnnnnnnnnnnn

SEQ ID NO: 273728 - DNA, 129 bp, Homo sapiens; identical to SEQ ID NO: 273717
  misc_feature: GYAE6OF02HIILE.49.41.D08.1.454.CMB.1.raw
  modified_base (126)..(129): a, c, t, g, unknown or other
  misc_feature (126)..(129): n is a, c, g, or t

SEQ ID NO: 273729 - DNA, 128 bp, Homo sapiens; identical to SEQ ID NO: 273512
  misc_feature: GYAE6OF02I2TSR.49.41.D08.1.454.CMB.1.raw
  modified_base (127)..(128): a, c, t, g, unknown or other
  misc_feature (127)..(128): n is a, c, g, or t

SEQ ID NO: 273730 - DNA, 127 bp, Homo sapiens; identical to SEQ ID NO: 273487
  misc_feature: GYAE6OF02FIQR5.49.41.D08.1.454.CMB.1.raw
  modified_base (127)..(127): a, c, t, g, unknown or other
  misc_feature (127)..(127): n is a, c, g, or t

SEQ ID NO: 273731 - DNA, 130 bp, Homo sapiens
  misc_feature: GYAE6OF02HWRKP.49.41.D08.1.454.CMB.1.raw
  modified_base (121)..(121): a, c, t, g, unknown or other
  misc_feature (121)..(121): n is a, c, g, or t
  modified_base (127)..(130): a, c, t, g, unknown or other
  misc_feature (127)..(130): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggcncatagnnnn

SEQ ID NO: 273732 - DNA, 127 bp, Homo sapiens; identical to SEQ ID NO: 273495
  misc_feature: GYAE6OF02GEA3G.49.41.D08.1.454.CMB.1.raw
  modified_base (127)..(127): a, c, t, g, unknown or other
  misc_feature (127)..(127): n is a, c, g, or t

SEQ ID NO: 273733 - DNA, 523 bp, Homo sapiens
  misc_feature: GYAE6OF02IV4JJ.49.41.D08.1.454.CMB.1.raw
tcagagtcgagagacacgaccggtgctcgatttagtcacgcgagaaagggaaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagctttgagaggccctcgacgggacccctgagcgattctctggcctcagctcgagggacaacagtccaccttgaccatcagtggagtccggcagaggacgaggctgacttattacgtgtcagtccgcagacagcagtggactagttatgtcgtagttcgggacggtagggactcggctggtacccgtccgtaggtcgacggcccaaggcctccggcccctcgg

SEQ ID NO: 273734 - DNA, 130 bp, Homo sapiens
  misc_feature: GYAE6OF02FVZT8.49.41.D08.1.454.CMB.1.raw
  modified_base (127)..(130): a, c, t, g, unknown or other
  misc_feature (127)..(130): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgcatagnnnn

SEQ ID NO: 273735 - DNA, 129 bp, Homo sapiens
  misc_feature: GYAE6OF02GGP11.49.41.D08.1.454.CMB.1.raw
  modified_base (127)..(129): a, c, t, g, unknown or other
  misc_feature (127)..(129): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcgcatagnnn

SEQ ID NO: 273736 - DNA, 166 bp, Homo sapiens
  misc_feature: GYAE6OF02GX27M.49.41.D08.1.454.CMB.1.raw
  modified_base (129)..(166): a, c, t, g, unknown or other
  misc_feature (129)..(166): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcataggnnnnnnnnnnnnnnnnnnnnnnnnnnnnnnnnnnnnnn

SEQ ID NO: 273737 - DNA, 130 bp, Homo sapiens
  misc_feature: GYAE6OF02IFZK4.49.41.D08.1.454.CMB.1.raw
  modified_base (127)..(130): a, c, t, g, unknown or other
  misc_feature (127)..(130): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggcgcatagnnnn

SEQ ID NO: 273738 - DNA, 128 bp, Homo sapiens; identical to SEQ ID NO: 273575
  misc_feature: GYAE6OF02FQ89A.49.41.D08.1.454.CMB.1.raw
  modified_base (128)..(128): a, c, t, g, unknown or other
  misc_feature (128)..(128): n is a, c, g, or t

SEQ ID NO: 273739 - DNA, 127 bp, Homo sapiens
  misc_feature: GYAE6OF02IT3PU.49.41.D08.1.454.CMB.1.raw
  modified_base (127)..(127): a, c, t, g, unknown or other
  misc_feature (127)..(127): n is a, c, g, or t
tcagagtcgagagacacgaccggtgctcgatttagtcacgcgagaaagggaagggggctggccctgacgtgtttctgttcccaccctcctctctctcgactctgagcgggctggcaaggcgcatagn

SEQ ID NO: 273740 - DNA, 126 bp, Homo sapiens; identical to SEQ ID NO: 273589
  misc_feature: GYAE6OF02HM9KU.49.41.D08.1.454.CMB.1.raw

SEQ ID NO: 273741 - DNA, 127 bp, Homo sapiens; identical to SEQ ID NO: 273613
  misc_feature: GYAE6OF02IZ69Z.49.41.D08.1.454.CMB.1.raw

SEQ ID NO: 273742 - DNA, 126 bp, Homo sapiens
  misc_feature: GYAE6OF02HOLMX.49.41.D08.1.454.CMB.1.raw
  modified_base (125)..(126): a, c, t, g, unknown or other
  misc_feature (125)..(126): n is a, c, g, or t
tcagagtcgagagacacgaccggtgctcgatttagtcacgcgagaaagggaaagggtggccctgacgtgtttctgttcccaccctcctctctctcgactctgagcgggctggcaaggcgcatagnn

SEQ ID NO: 273743 - DNA, 130 bp, Homo sapiens
  misc_feature: GYAE6OF02IHTN3.49.41.D08.1.454.CMB.1.raw
  modified_base (126)..(130): a, c, t, g, unknown or other
  misc_feature (126)..(130): n is a, c, g, or t
tcagagtcgagagacacgaccggtgctcgatttagtcacgcgagaaagggaaggggctggccctgacgtgtttctgttcccaccctcctctctctcgactctgagcgggctggcaaggcgcatagnnnnn

SEQ ID NO: 273744 - DNA, 130 bp, Homo sapiens
  misc_feature: GYAE6OF02FJGA6.49.41.D08.1.454.CMB.1.raw
  modified_base (126)..(130): a, c, t, g, unknown or other
  misc_feature (126)..(130): n is a, c, g, or t
tcagagtcgagagacacgaccggtgctcgatttagtcacgcgagaaagggaagggggctggccctgacgtgtttctgttcccgcctcctctctctcgactctgagcgggctggcaaggcgcatagnnnnn

SEQ ID NO: 273745 - DNA, 131 bp, Homo sapiens
  misc_feature: GYAE6OF02IEBNT.49.41.D08.1.454.CMB.1.raw
  modified_base (128)..(131): a, c, t, g, unknown or other
  misc_feature (128)..(131): n is a, c, g, or t
tcagagtcgagagacacgaccggtgctcgatttagtcacgcgagaaagggaaagggggcgtggccctgacgtgtttctgttcccaccctcctcttctcgactctgagcgggctggcaaggcgcatagnnnn

SEQ ID NO: 273746 - DNA, 148 bp, Homo sapiens
  misc_feature: GYAE6OF02FUKFW.49.41.D08.1.454.CMB.1.raw
  modified_base (128)..(148): a, c, t, g, unknown or other
  misc_feature (128)..(148): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnnnnnnnnnnnnnnnnnnn

SEQ ID NO: 273747 - DNA, 127 bp, Homo sapiens; identical to SEQ ID NO: 273495
  misc_feature: GYAE6OF02GGW6L.49.41.D08.1.454.CMB.1.raw
  modified_base (127)..(127): a, c, t, g, unknown or other
  misc_feature (127)..(127): n is a, c, g, or t

SEQ ID NO: 273748 - DNA, 127 bp, Homo sapiens
  misc_feature: GYAE6OF02H1ZGW.49.41.D08.1.454.CMB.1.raw
tcagagtcgagagacacgaccggtgctcgatttagtcacgcgagaaagggaaagggggctggccctgacgtgtttctgttcccgccctcctctctctcgactctgagcgggctggcaaggcgcatag

SEQ ID NO: 273749 - DNA, 131 bp, Homo sapiens; identical to SEQ ID NO: 273714
  misc_feature: GYAE6OF02G67H9.49.41.D08.1.454.CMB.1.raw
  modified_base (127)..(131): a, c, t, g, unknown or other
  misc_feature (127)..(131): n is a, c, g, or t

SEQ ID NO: 273750 - DNA, 186 bp, Homo sapiens
  misc_feature: GYAE6OF02GXND1.49.41.D08.1.454.CMB.1.raw
  modified_base (123)..(123): a, c, t, g, unknown or other
  misc_feature (123)..(123): n is a, c, g, or t
  modified_base (129)..(129): a, c, t, g, unknown or other
  misc_feature (129)..(129): n is a, c, g, or t
  modified_base (131)..(136): a, c, t, g, unknown or other
  misc_feature (131)..(136): n is a, c, g, or t
  modified_base (138)..(186): a, c, t, g, unknown or other
  misc_feature (138)..(186): n is a, c, g, or t
tcagagtcgagagacacgaccggtgctcgatttagtcacgcgagaaagggaaagggggctggccctgacgtgtttctgttcccgccctcctctctcctcgactctgagcgggctggcaaggcncatagngnnnnnnannnnnnnnnnnnnnnnnnnnnnnnnnnnnnnnnnnnnnnnnnnnnnnnn

SEQ ID NO: 273751 - DNA, 128 bp, Homo sapiens; identical to SEQ ID NO: 273596
  misc_feature: GYAE6OF02GJAX6.49.41.D08.1.454.CMB.1.raw
  modified_base (127)..(128): a, c, t, g, unknown or other
  misc_feature (127)..(128): n is a, c, g, or t

SEQ ID NO: 273752 - DNA, 130 bp, Homo sapiens
  misc_feature: GYAE6OF02GZB6E.49.41.D08.1.454.CMB.1.raw
  modified_base (77)..(77): a, c, t, g, unknown or other
  misc_feature (77)..(77): n is a, c, g, or t
  modified_base (122)..(122): a, c, t, g, unknown or other
  misc_feature (122)..(122): n is a, c, g, or t
  modified_base (128)..(130): a, c, t, g, unknown or other
  misc_feature (128)..(130): n is a, c, g, or t
tcagagtcgagagacacgaccggtgctcgatttagtcacgcgagaaagggaaagggggctggccctgacgtgtttcngttcccaccctcctctctctcgactctgagcgggctggcaaggcncatagnnn

SEQ ID NO: 273753 - DNA, 615 bp, Homo sapiens
  misc_feature: GYAE6OF02HMVOL.49.41.D08.1.454.CMB.1.raw
  modified_base (105)..(105): a, c, t, g, unknown or other
  misc_feature (105)..(105): n is a, c, g, or t
  modified_base (129)..(130): a, c, t, g, unknown or other
  misc_feature (129)..(130): n is a, c, g, or t
  modified_base (133)..(134): a, c, t, g, unknown or other
  misc_feature (133)..(134): n is a, c, g, or t
  modified_base (137)..(138): a, c, t, g, unknown or other
  misc_feature (137)..(138): n is a, c, g, or t
  modified_base (141)..(141): a, c, t, g, unknown or other
  misc_feature (141)..(141): n is a, c, g, or t
  modified_base (144)..(144): a, c, t, g, unknown or other
  misc_feature (144)..(144): n is a, c, g, or t
  modified_base (148)..(148): a, c, t, g, unknown or other
  misc_feature (148)..(148): n is a, c, g, or t
  modified_base (154)..(154): a, c, t, g, unknown or other
  misc_feature (154)..(154): n is a, c, g, or t
  modified_base (158)..(158): a, c, t, g, unknown or other
  misc_feature (158)..(158): n is a, c, g, or t
  modified_base (164)..(164): a, c, t, g, unknown or other
  misc_feature (164)..(164): n is a, c, g, or t
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
tcagagtcgagagacacgaccggtgctcgatttagtcacgcgagaaagggaaagggggcgtggccctgacgtgtttctgttcccacctcctctctctccgactcngagcgggctggcaaggcgcatagnntgnntcnngancgngcangtgacntgangtgcgngcgtgctncggnaccgtgagcgtggctcncgtgcgcgggccngtctgtcgcncgtgacgcgtcgtcgtcgtaactacgtcgtcgtgtaaccgngtacgngacgacgcgttggcgcgtactagnggacggngtccgaagtggtcgtcgaagttcgactacggtcaacgtacggtactcgtacagtcgtacgtcgtacggactgacacggtttcggaccgtacgggtaacccataccggttactccgtaccgacgtacgtacgtacgtacgtacgtacgtacgtacgtacgtacgtacgtacgacgtacgtacgtacgtacgtacgttacgtacgtacggtacgacgtacgacgtaccgtaccgtacggaccggtacggtacggtacggtacggtacggtacggttacgtacggttacgttcggtacgttaccggtacggtacggtacgtacg

SEQ ID NO: 273754 - DNA, 127 bp, Homo sapiens; identical to SEQ ID NO: 273632
  misc_feature: GYAE6OF02FXT64.49.41.D08.1.454.CMB.1.raw
  modified_base (126)..(127): a, c, t, g, unknown or other
  misc_feature (126)..(127): n is a, c, g, or t

SEQ ID NO: 273755 - DNA, 144 bp, Homo sapiens
  misc_feature: GYAE6OF02HKMQ8.49.41.D08.1.454.CMB.1.raw
  modified_base (125)..(144): a, c, t, g, unknown or other
  misc_feature (125)..(144): n is a, c, g, or t
tcagagtcgagagacacgaccggtgctcgatttagtcacgcgagaaagggaaggggctggccctgacgtgtttctgttcccacctcctctctctcgactctgagcgggctggcaaggcgcatagnnnnnnnnnnnnnnnnnnnn

SEQ ID NO: 273756 - DNA, 129 bp, Homo sapiens
  misc_feature: GYAE6OF02G3V76.49.41.D08.1.454.CMB.1.raw
  modified_base (128)..(129): a, c, t, g, unknown or other
  misc_feature (128)..(129): n is a, c, g, or t
tcagagtcgagagacacgaccggtgctcgatttagtcacgcgagaaagggaaagggggctggccctgacgtgtttctgttcccgccctcctctctctcgactctgagcgggctggcaaggcgcatagnn

SEQ ID NO: 273757 - DNA, 130 bp, Homo sapiens; identical to SEQ ID NO: 273550
  misc_feature: GYAE6OF02H7EX7.49.41.D08.1.454.CMB.1.raw
  modified_base (128)..(130): a, c, t, g, unknown or other
  misc_feature (128)..(130): n is a, c, g, or t

SEQ ID NO: 273758 - DNA, 127 bp, Homo sapiens; identical to SEQ ID NO: 273613
  misc_feature: GYAE6OF02FPKW9.49.41.D08.1.454.CMB.1.raw

SEQ ID NO: 273759 - DNA, 185 bp, Homo sapiens
  misc_feature: GYAE6OF02GXE7I.49.41.D08.1.454.CMB.1.raw
  modified_base (77)..(77): a, c, t, g, unknown or other
  misc_feature (77)..(77): n is a, c, g, or t
  modified_base (124)..(124): a, c, t, g, unknown or other
  misc_feature (124)..(124): n is a, c, g, or t
  modified_base (130)..(185): a, c, t, g, unknown or other
  misc_feature (130)..(185): n is a, c, g, or t
tcagagtcgagagacacgaccggtgctcgatttagtcacgcgagaaagggaagggggctgggccctgacgtgtttcngttcccgaccctcctctctctcgactctgagcgggctgggcaaggcncatagnnnnnnnnnnnnnnnnnnnnnnnnnnnnnnnnnnnnnnnnnnnnnnnnnnnnnnnn

SEQ ID NO: 273760 - DNA, 130 bp, Homo sapiens
  misc_feature: GYAE6OF02GLXQA.49.41.D08.1.454.CMB.1.raw
  modified_base (124)..(130): a, c, t, g, unknown or other
  misc_feature (124)..(130): n is a, c, g, or t
tcagagtcgagagacacgaccggtgctcgatttagtcacgcgagaaagggaaggggctggcctgacgtgtttctgttcccacctcctctctctcgactctgagcgggctggcaaggcgcatagnnnnnnn

SEQ ID NO: 273761 - DNA, 129 bp, Homo sapiens
  misc_feature: GYAE6OF02H5C9S.49.41.D08.1.454.CMB.1.raw
  modified_base (126)..(129): a, c, t, g, unknown or other
  misc_feature (126)..(129): n is a, c, g, or t
tcagagtcgagagacacgaccggtgctcgatttagtcacgcgagaaagggaaggggctggccctgacgtgtttctgttcccgccctcctctctctcgactctgagcgggctggcaaggcgcatagnnnn

SEQ ID NO: 273762 - DNA, 137 bp, Homo sapiens
  misc_feature: GYAE6OF02G4V1E.49.41.D08.1.454.CMB.1.raw
  modified_base (125)..(137): a, c, t, g, unknown or other
  misc_feature (125)..(137): n is a, c, g, or t
tcagagtcgagagacacgaccggtgctcgatttagtcacgcgagaaagggaaggggctggccctgacgtgtttctgttcccacctcctctctctcgactctgagcgggctggcaaggcgcatagnnnnnnnnnnnnn

SEQ ID NO: 273763 - DNA, 127 bp, Homo sapiens; identical to SEQ ID NO: 273613
  misc_feature: GYAE6OF02GQ4L8.49.41.D08.1.454.CMB.1.raw

SEQ ID NO: 273764 - DNA, 143 bp, Homo sapiens
  misc_feature: GYAE6OF02I5XA4.49.41.D08.1.454.CMB.1.raw
  modified_base (128)..(143): a, c, t, g, unknown or other
  misc_feature (128)..(143): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnnnnnnnnnnnnnn

SEQ ID NO: 273765 - DNA, 127 bp, Homo sapiens; identical to SEQ ID NO: 273487
  misc_feature: GYAE6OF02HXPAS.49.41.D08.1.454.CMB.1.raw
  modified_base (127)..(127): a, c, t, g, unknown or other
  misc_feature (127)..(127): n is a, c, g, or t

SEQ ID NO: 273766 - DNA, 131 bp, Homo sapiens
  misc_feature: GYAE6OF02FJQYJ.49.41.D08.1.454.CMB.1.raw
  modified_base (127)..(131): a, c, t, g, unknown or other
  misc_feature (127)..(131): n is a, c, g, or t
tcagagtcgagagacacgaccggtgctcgatttagtcacgcgagaaagggaaagggggctggccctgacgtgtttctgttccaccctcctctctctcgactctgagcgggctggcaaggcgcatagnnnnn

SEQ ID NO: 273767 - DNA, 137 bp, Homo sapiens
  misc_feature: GYAE6OF02F7CLM.49.41.D08.1.454.CMB.1.raw
  modified_base (127)..(137): a, c, t, g, unknown or other
  misc_feature (127)..(137): n is a, c, g, or t
tcagagtcgagagacacgaccggtgctcgatttagtcacgcgagaaagggaagggggctggccctgacgtgtttctgttcccgccctcctctctctcgactctgagcgggctggcaaggcgcatagnnnnnnnnnnn

SEQ ID NO: 273768 - DNA, 130 bp, Homo sapiens
  misc_feature: GYAE6OF02HCUUI.49.41.D08.1.454.CMB.1.raw
  modified_base (128)..(130): a, c, t, g, unknown or other
  misc_feature (128)..(130): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnn

SEQ ID NO: 273769 - DNA, 139 bp, Homo sapiens
  misc_feature: GYAE6OF02IVJQV.49.41.D08.1.454.CMB.1.raw
  modified_base (77)..(77): a, c, t, g, unknown or other
  misc_feature (77)..(77): n is a, c, g, or t
  modified_base (128)..(139): a, c, t, g, unknown or other
  misc_feature (128)..(139): n is a, c, g, or t
tcagagtcgagagacacgaccggtgctcgatttagtcacgcgagaaagggaaagggggctggccctgacgtgtttcngttcccaccctcctctctctcgactctgagcgggctggcaaggcgcatagnnnnnnnnnnnn

SEQ ID NO: 273770 - DNA, 127 bp, Homo sapiens
  misc_feature: GYAE6OF02IOF9C.49.41.D08.1.454.CMB.1.raw
  modified_base (127)..(127): a, c, t, g, unknown or other
  misc_feature (127)..(127): n is a, c, g, or t
tcagagtcgagagacacgaccggtgctcgatttagtcacgcgagaaagggaaagggggctggccctgacgtgtttctgttcccacctcctctctctcgactctgagcgggctggcaaggcgcatagn

SEQ ID NO: 273771 - DNA, 127 bp, Homo sapiens; identical to SEQ ID NO: 273613
  misc_feature: GYAE6OF02ISVYL.49.41.D08.1.454.CMB.1.raw

SEQ ID NO: 273772 - DNA, 128 bp, Homo sapiens; identical to SEQ ID NO: 273575
  misc_feature: GYAE6OF02ISG7O.49.41.D08.1.454.CMB.1.raw
  modified_base (128)..(128): a, c, t, g, unknown or other
  misc_feature (128)..(128): n is a, c, g, or t

SEQ ID NO: 273773 - DNA, 128 bp, Homo sapiens; identical to SEQ ID NO: 273575
  misc_feature: GYAE6OF02G01H9.49.41.D08.1.454.CMB.1.raw
  modified_base (128)..(128): a, c, t, g, unknown or other
  misc_feature (128)..(128): n is a, c, g, or t

SEQ ID NO: 273774 - DNA, 127 bp, Homo sapiens
  misc_feature: GYAE6OF02GI5LB.49.41.D08.1.454.CMB.1.raw
  modified_base (127)..(127): a, c, t, g, unknown or other
  misc_feature (127)..(127): n is a, c, g, or t
tcagagtcgagagacacgaccggtgctcgatttagtcacgcgagaaagggaaagggggctggccctgacgtgtttctgttcccgccccctctctctcgactctgagcgggctggcaaggcgcatagn

SEQ ID NO: 273775 - DNA, 127 bp, Homo sapiens; identical to SEQ ID NO: 273748
  misc_feature: GYAE6OF02G52M4.49.41.D08.1.454.CMB.1.raw

SEQ ID NO: 273776 - DNA, 202 bp, Homo sapiens
  misc_feature: GYAE6OF02FPP8O.49.41.D08.1.454.CMB.1.raw
  modified_base (140)..(145): a, c, t, g, unknown or other
  misc_feature (140)..(145): n is a, c, g, or t
  modified_base (147)..(202): a, c, t, g, unknown or other
  misc_feature (147)..(202): n is a, c, g, or t
tcagagtcgagagacacgaccggtgctcgatttagtcacgcgagaaaggggaaaggggggctggccctgacgtgtttctgttccccaccctccgtctctctccgactctcgaggcgggcctggctaaggcccgccatagnnnnnngnnnnnnnnnnnnnnnnnnnnnnnnnnnnnnnnnnnnnnnnnnnnnnnnnnnnnnnn

SEQ ID NO: 273777 - DNA, 126 bp, Homo sapiens; identical to SEQ ID NO: 273589
  misc_feature: GYAE6OF02GD5OF.49.41.D08.1.454.CMB.1.raw

SEQ ID NO: 273778 - DNA, 127 bp, Homo sapiens
  misc_feature: GYAE6OF02JE7LN.49.41.D08.1.454.CMB.1.raw
  modified_base (124)..(127): a, c, t, g, unknown or other
  misc_feature (124)..(127): n is a, c, g, or t
tcagagtcgagagacacgaccggtgctcgatttagtcacgcgagaaagggaaagggggctggccctgacgtgtttctgttccgccctcctctctctcgactctgagcgggctggcaaggcgcannnn

SEQ ID NO: 273779 - DNA, 130 bp, Homo sapiens; identical to SEQ ID NO: 273768
  misc_feature: GYAE6OF02IM2P7.49.41.D08.1.454.CMB.1.raw
  modified_base (128)..(130): a, c, t, g, unknown or other
  misc_feature (128)..(130): n is a, c, g, or t

SEQ ID NO: 273780 - DNA, 112 bp, Homo sapiens
  misc_feature: GYAE6OF02G1UGV.49.41.D08.1.454.CMB.1.raw
  modified_base (107)..(112): a, c, t, g, unknown or other
  misc_feature (107)..(112): n is a, c, g, or t
tcagagtcgagagacacgaccggtgctcgatttagtcacgcgagaaagggaaagggcaagcagaagacggcatacgagatcctgagcgggctggcaaggcgcatagnnnnnn

SEQ ID NO: 273781 - DNA, 165 bp, Homo sapiens
  misc_feature: GYAE6OF02GH5T1.49.41.D08.1.454.CMB.1.raw
  modified_base (76)..(76): a, c, t, g, unknown or other
  misc_feature (76)..(76): n is a, c, g, or t
  modified_base (128)..(165): a, c, t, g, unknown or other
  misc_feature (128)..(165): n is a, c, g, or t
tcagagtcgagagacacgaccggtgctcgatttagtcacgcgagaaagggaaaggggctggccctgacgtgtttcngttcccaccctcctctctctcgactctgagcgggctggcaaggcgcataggnnnnnnnnnnnnnnnnnnnnnnnnnnnnnnnnnnnnnn

SEQ ID NO: 273782 - DNA, 132 bp, Homo sapiens
  misc_feature: GYAE6OF02HG1UH.49.41.D08.1.454.CMB.1.raw
  modified_base (128)..(132): a, c, t, g, unknown or other
  misc_feature (128)..(132): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnnn

SEQ ID NO: 273783 - DNA, 211 bp, Homo sapiens
  misc_feature: GYAE6OF02I38E0.49.41.D08.1.454.CMB.1.raw
  modified_base (131)..(132): a, c, t, g, unknown or other
  misc_feature (131)..(132): n is a, c, g, or t
  modified_base (134)..(211): a, c, t, g, unknown or other
  misc_feature (134)..(211): n is a, c, g, or t
tcagagtcgagagacacgaccggtgctcgatttagtcacgcgagaaagggaaaggggctggccctgacgtgtttctgttcccaccctcctctctctcgaactctgagcgggctgggcaaggccacatagcnnannnnnnnnnnnnnnnnnnnnnnnnnnnnnnnnnnnnnnnnnnnnnnnnnnnnnnnnnnnnnnnnnnnnnnnnnnnnnn

SEQ ID NO: 273784 - DNA, 132 bp, Homo sapiens
  misc_feature: GYAE6OF02F7XDW.49.41.D08.1.454.CMB.1.raw
  modified_base (121)..(121): a, c, t, g, unknown or other
  misc_feature (121)..(121): n is a, c, g, or t
  modified_base (127)..(132): a, c, t, g, unknown or other
  misc_feature (127)..(132): n is a, c, g, or t
tcagagtcgagagacacgaccggtgctcgatttagtcacgcgagaaagggaaaggggctggccctgacgtgtttctgttcccaccctcctctctctcgactctgagcgggctggcaaggcncatagnnnnnn

SEQ ID NO: 273785 - DNA, 128 bp, Homo sapiens; identical to SEQ ID NO: 273575
  misc_feature: GYAE6OF02IM504.49.41.D08.1.454.CMB.1.raw
  modified_base (128)..(128): a, c, t, g, unknown or other
  misc_feature (128)..(128): n is a, c, g, or t

SEQ ID NO: 273786 - DNA, 132 bp, Homo sapiens; identical to SEQ ID NO: 273782
  misc_feature: GYAE6OF02GYZRJ.49.41.D08.1.454.CMB.1.raw
  modified_base (128)..(132): a, c, t, g, unknown or other
  misc_feature (128)..(132): n is a, c, g, or t

SEQ ID NO: 273787 - DNA, 135 bp, Homo sapiens
  misc_feature: GYAE6OF02F2T5D.49.41.D08.1.454.CMB.1.raw
  modified_base (128)..(135): a, c, t, g, unknown or other
  misc_feature (128)..(135): n is a, c, g, or t
tcagagtcgagagacacgaccggtgctcgatttagtcacgcgagaaagggaaagggggctggccctgacgtgtttctgttcccaccctcctctctctcgactctgagcgggctggcaaggcgcatagnnnnnnnn

SEQ ID NO: 273788 - DNA, 151 bp, Homo sapiens
  misc_feature: GYAE6OF02HF89V.49.41.D08.1.454.CMB.1.raw
  modified_base (127)..(151): a, c, t, g, unknown or other
  misc_feature (127)..(151): n is a, c, g, or t
tcagagtcgagagacacgaccggtgctcgatttagtcacgcgagaaagggaaaggggctggccctgacgtgtttctgttcccgccctcctctctctcgactctgagcgggctggcaaggcgcatagnnnnnnnnnnnnnnnnnnnnnnnnn

SEQ ID NO: 273789 - DNA, 141 bp, Homo sapiens
  misc_feature: GYAE6OF02JIDLV.49.41.D08.1.454.CMB.1.raw
  modified_base (128)..(141): a, c, t, g, unknown or other
  misc_feature (128)..(141): n is a, c, g, or t
tcagagtcgagagacacgaccggtgctcgatttagtcacgcgagaaagggaaagggggctggccctgacgtgtttctgttcccgccctcctctctctcgactctgagcgggctggcaaggcgcatagnnnnnnnnnnnnnn

SEQ ID NO: 273790 - DNA, 354 bp, Homo sapiens
  misc_feature: GYAE6OF01DSM78.39.20.B09.1.454.CMB.1.raw
  modified_base (350)..(354): a, c, t, g, unknown or other
  misc_feature (350)..(354): n is a, c, g, or t
tcagtcgcactagtcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccagagcacctctgggggcacagcggccctgggctgcctggtcaaggactacttccactagtgcgactgagcgggctggcaaggcgcatagnnnnn

SEQ ID NO: 273791 - DNA, 507 bp, Homo sapiens
  misc_feature: GYAE6OF01AOBTD.39.20.B09.1.454.CMB.1.raw
  modified_base (421)..(421): a, c, t, g, unknown or other
  misc_feature (421)..(421): n is a, c, g, or t
  modified_base (455)..(455): a, c, t, g, unknown or other
  misc_feature (455)..(455): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
tcagtcgcactagtcacgaccggtgctcgatttagtgtagtgtgaagggagcaccgtggagaagacagtggcccctacagaatgttcataggttcccaactctaaccccacccacgggagcctggagctgcaggatcccaggggaggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctcctggtaccaacacacccaggcaaacgcccccaaactcatcatttatgatgtcactaagccgaccctcacggggtncctgactcgcttctctgcctcaagtctggcaacncggcctccctgaccctatctcgtcgggcctccagtctagaagntggnggtac

SEQ ID NO: 273792 - DNA, 686 bp, Homo sapiens
  misc_feature: GYAE6OF01CU61V.39.20.B09.1.454.CMB.1.raw
  modified_base (121)..(121): a, c, t, g, unknown or other
  misc_feature (121)..(121): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (341)..(341): a, c, t, g, unknown or other
  misc_feature (341)..(341): n is a, c, g, or t
tcagtcgcactagtcacgaccggtgctcgatttagtgtagtgtgaagggagcaccgtggagaagacagtggcccctacagaatgttcataggttcccaactcctaaccccacccacgggancctggagctgcaggactcccgaggggagggtctcgaggaggcagcactcgtcgggactctccacagtcggcctgggctcgtgcctcctcctcacgccctcctcactcgagggcacgaggtactccgtgggctcagtctcgccctgactcgacgcctcgctcgagtcgtccggtctcgnggacngtcagtccactntcctcgtcgactacgtacgaaaccngacgtagtgtacgttggttaggttagttaactacgtagtcgtacctaccgttacgaacccaacgaccgaccgtaacggaaccaaacccgtcccctaaagtcctaacgttactaactttagacgtactaccgtaacaaccgtacgtacccgtaacccgtgggtaacggtctaccgttaagtaccgtccgttaccgtttacctccggtacccgtacccgtaacgtaacggttcctaaccggaccgtaacccggtcccgttaccccgcccgttaaacgacccttcggtacccgttcggtacgtccccgttaacgtcgtacgttacgaacgttcggtacgaggttaccc

SEQ ID NO: 273793 - DNA, 556 bp, Homo sapiens
  misc_feature: GYAE6OF01B4M72.39.20.B09.1.454.CMB.1.raw
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (429)..(429): a, c, t, g, unknown or other
  misc_feature (429)..(429): n is a, c, g, or t
tcagtcgcactagtcacgaccggtgctcgatttagtgtagtgtgaagggagcaccgtggagaagacagtggcccctacagaatgttcataggttcccaactctaaccccacccacgggagcctggagctgcaggatcccaggggaggggtctcaggaggcagcactctcgggacgtctccaccatggcctgggctctgctcctcctcagcctcctcactcagggcacaggatccgtgggctcagtctgcccctgactcagcctcgctcagtcgtccggtctcctggacngtcagtcaccntctcctgcactggaaccngcagtgatgtggtgtataactntcgtctcgtggtaaccaacaccacccaggaccaaaacgccccaaatcactcattatgatcgtactactaagccgtacctcgacgggtcncctgactccgtacttcgtctcgccctccgtaacttcgtacggaccaacgacccggtcccttaccctcgacctacgtccttccgtcgggtcctaccgacgttccgtacgtaagcgtggacggttaacg

SEQ ID NO: 273794 - DNA, 659 bp, Homo sapiens
  misc_feature: GYAE6OF01ALU30.39.20.B09.1.454.CMB.1.raw
  modified_base (238)..(238): a, c, t, g, unknown or other
  misc_feature (238)..(238): n is a, c, g, or t
  modified_base (380)..(380): a, c, t, g, unknown or other
  misc_feature (380)..(380): n is a, c, g, or t
  modified_base (457)..(457): a, c, t, g, unknown or other
  misc_feature (457)..(457): n is a, c, g, or t
tcagtcgcactagtcacgaccggtgctcgatttagtgtagtgtgaagggagcaccgtggagaagacagtggcccctacagaatgttcataggttcccaactctaaccccacccacgggagcctggagctgcaggatcccaggggaggggtctcaggaggcagcactccgtcgggacgtctccaccatcggcctgggctctgcctcctcctcacgcctcctcactcgagggcacgaggntccgtgggctcacgtctcgccctgactcagcctcgcctcaggtcggtccgggtcctccgtggacctgtcagtccaccatcctccgtcggacctaccgtacggaacccagcgtaagtcgtatggtttggtagttaataacgtnttcgtaccttccgtacggtaaccaaacaacccgacccgaggaaccaaaccgacccccaaacgtcactactaatttancgtattcgacctaacgtaacgcccgtaacccgtcggacggggttctcctagtactccggttctttccgtccgttccgtccctaacgtaccgttccgtacggacccaaccgtccccggcccttacccccgacgtaccgtaccgtcgttccggtccggtacccgtccgtacggttccgtaggtaacacggttaggacggttaac

SEQ ID NO: 273795 - DNA, 672 bp, Homo sapiens
  misc_feature: GYAE6OF01BLCZD.39.20.B09.1.454.CMB.1.raw
tcagtcgcactagtcacgaccggtgctcgatttagtgtagtgtgaagggagcaccgtggagaagacagtggcccctacagaatgttcataggttcccaactctaaccccacccacgggagcctggagctgcaggatcccgaggggaggggtctcagggaggcagcactcgtcgggacgtctccaccatcggcctgggctctgcctcctcctcacgcctcctcactcgagggcacgaggtactccgtgggcctcgacgtcctcggccctgacctcgacgcccgtcgtctcgtacggttccggtcccggggtccttccgtacgggaactacggtccaacggtccaacctacgttcctccgtcggacctacggtacggaacccagacgtagtagtacgtttggttacggttagttaacgtaaacttgttccgtctaccgtacgtaaccaaccgtaaccacccgaacggacccaaaccgtaccccctaaacgtacaacttactaatttacgagttactacgtactaacgtacgaccgtaccgtggacggtcgtctagtcttccgtccttctccgtccgccttaccgtagttcgacgaccgaccgtccgtcccgtacctacgacgtcgtccgtcggtcggcccttacgacgtacgtacggagtacgtgacgttaacg

SEQ ID NO: 273796 - DNA, 710 bp, Homo sapiens
  misc_feature: GYAE6OF01CT841.39.20.B09.1.454.CMB.1.raw
  modified_base (290)..(290): a, c, t, g, unknown or other
  misc_feature (290)..(290): n is a, c, g, or t
tcagtcgcactagtcacgaccggtgctcgatttagtgtagtgtgaagggagcaccgtggagaagacagtggcccctacagaatgttcataggttcccaactcctaaccccacccacgggagcctgagctgcaggatcccgaggggagggtctcgaggaggcagcactcgtcgggactcctccaccagtggcctgggctcgtgcctccctcctcacgccctcctcacctcgagggcacgacggactccgtggcctcacgtcctcgccctgactcgacgtcctcgtctacgnggttccgtccggtctccgtagacctgtcacgtccaccgtactcctccgtgccctacgtaccgaaccgtacgtaccgtagtacgagtttcggttaggttaggttaactaaacgttgtccgttacctccgttaacggtaaacccaaaccacccgtaacccgacggaacctaaacccggaccccctaaatacctacgtactttaacttagtacgtattaccgtacgtaaaccgtaccgcccgtaccgtacgggtacgggtctccgtacgtactccgttcttaccgtcccgttaccgacccgttcgtaaccgttacgaccggttaccaaccggtcccgtaccccgttacctaccgtacccgttaccgtccggttaccgtcggtaccttccggtaacgtctaacggtatacgtggtacgttaaac

SEQ ID NO: 273797 - DNA, 537 bp, Homo sapiens
  misc_feature: GYAE6OF02I4NYE.39.20.B09.1.454.CMB.1.raw
  modified_base (391)..(391): a, c, t, g, unknown or other
  misc_feature (391)..(391): n is a, c, g, or t
tcagtcgcactagtcacgaccggtgctcgatttagtgtagtgtgaagggagcaccgtggagaagacagtggcccctacagaatgttcataggttcccaactctaacccacccacgggagcctggagctgcaggatcccaggggaggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctcctgcactcggaaccagcagtgatgttggtgttataactatgtctctgtaccaacaacacccaggacaacgaccccaaatcatcatttangatgtacactacgcgaccttgagggtcgcctgactcgtcttctcctcgcctactacgtctcggactaaccgaccggtccctcccgtcgaccctattccctcgtcgggtcctaccgtagttccgtaggtaactacgtggtacggtac

SEQ ID NO: 273798 - DNA, 356 bp, Homo sapiens
  misc_feature: GYAE6OF02HL841.39.20.B09.1.454.CMB.1.raw
  modified_base (353)..(356): a, c, t, g, unknown or other
  misc_feature (353)..(356): n is a, c, g, or t
tcagtcgcactagtcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggccaccctcctccaagacgcacctcgtgggggcacagcggccctgggctgcctggtcaaggactacttccattagtgcgactgagcgggctggcaaggcgcatagnnnn

SEQ ID NO: 273799 - DNA, 689 bp, Homo sapiens
  misc_feature: GYAE6OF02IG8BT.39.20.B09.1.454.CMB.1.raw
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
tcagtcgcactagtcacgaccggtgctcgatttagtgtagtgtgaagggagcaccgtggagaagacagtggcccctacagaatgttcataggttcccaactctaaccccacccacgggagcctggagctgcaggatcccaggggaggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcaccatctcctgcactgaaccngcagtnattgtggtagttataactatcgttctcgtaggtaacccaaactaacacccgaggaccaaaaccgccccctaaaactcctaacttaccgtaacttttaacgtacgtaattagtaccaacgtaacgtacccgtaacccgttacgtacgggggtccgtaccttcgtacgtaccgtcctttaccgttccgttacgtacccctttaccgtaacgttcccgttagggtaccgaaacccgtaacccggttaccccttaccccgttacggtaaccccgtacgtttaccccgttccggtaccggggttacccttacccggtaacggtttacccgtacgggtaaacgtaacggtttacgggaacgggtttaacccg

SEQ ID NO: 273800 - DNA, 828 bp, Homo sapiens
  misc_feature: GYAE6OF02IXCIQ.39.20.B09.1.454.CMB.1.raw
tcagtcgcactagtcacgaccggtgctcgatttagtgtagtgtgaagggagcaccgtggagaagacagtggccctacagaatgttcataggttcccaactctaacccacccacgggagcctggagctgcaggatcccgaggggaggggtctcgaggaggcagcactctcgggacgtctccaccatggcctgggctctgctcctcctcagcctcctcactcagggcacaggactccgtgggctcagtccgtgcctgactctagcctcgctcgtacgtcggtcccgggtctccgtaggtaccacgttcacgttccacctagtcctccgtacgccacgttaccggaaccgtagcctaggtacgtactacggttttggtacggtttaactaacttacgtcgtttaccgtttcccgtacgggttaacccctaaaacgtaaccctaacccggaacgggtaaaccctaaaaccccgggtaacccccctaaaacgtacccgtaaacttcccggtttaaaacttttaaccgttacggttaacctttcggttaacctaaaccggttaaaccgtacccgtaacccggttacccggttaacgggggttacccgtcccgttaacggtaccggtacccggttaacgtttcccgttaccgttcccgaacccgtttacccgtaaacgggttcccgtttaacggacccgttaaaccgggacccttaccccgtcccgttaaccggtaccgttaacccgttcccggttaccggttccgggttacccgttacccgtacggttttacccgggacgttaccggggtaacccggtacggtcccgttaacgg

SEQ ID NO: 273801 - DNA, 753 bp, Homo sapiens
  misc_feature: GYAE6OF02F73P5.39.20.B09.1.454.CMB.1.raw
tcagtcgcactagtcacgaccggtgctcgatttagtgtagtgtgaagggagcaccgtggagaagacagtggcccctacagaatgttcataggttcccaactctaacccacccacgggagcctggagctgcaggatcccgaggggaggggtctcaggaggcagcactcgtcgggacgtctccaccatggcctgggctctgctcctcctcacgcctcctcactcgagggcacgaggactccgtgggctcgagtctcgccctgacctcgacgcctcgcctcgaggtcggtccggtctccgtggactagtcacgtccacctatcctcctgcctacgtacggaaccagtcgtaggtgtacttgggtttcggttagtttaactaacgttacgttcgttccttaccgttacggtaaacccaaacgtaacccgaaccggaacggaaaccctaaaaccccggtaaccccctaaactaccgtaactttacttaaacgttttaacgtacggtaacttaccggttaacctaaaccggttaaccggtacccggttaacccgtacggggtacgggtccgtaccgttacggtaccttccgttaccgtttccgtccgttacccgtacccgttaccgtacgttaccgtaccggtaccgtaaccggtcccgtaccctaccgtaccgtaccgttccgttaccgttccggttaccggtacccttaccggtacgttaccgtaacggtaacggtacggttacggtaacgttaacg

SEQ ID NO: 273802 - DNA, 591 bp, Homo sapiens
  misc_feature: GYAE6OF02JFF3X.39.20.B09.1.454.CMB.1.raw
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
tcagtcgcactagtcacgaccggtgctcgatttagtgtagtgtgaagggagcaccgtggagaagacagtggcccctacagaatgttcataggttcccaactctaaccccacccacgggagcctggagctgcaggatcccaggggagggtctcaggaggcagcactctcgggacgtctccacatggcctgggctctgctcctcctcagcctcctcactcagggcacaggatcctgggctcagtctgccctgactcagcctcgctcagtgtccgggtctccgtggacagtcagtcaccatcctcctgcacgtggaaccngcagtgatggtggtgttaataactntcgtctctaggtaccaacacctaccaggtaccaaacgcccccaaatccatctattatcgattgtactaacgtacgaccgtaccttcgaggggtcaccgtgtactccgtacttccgtactccgtaccctaccgtaacgttccgtacggacctaaccgcccggtccctcccgttacggacccttaacgtccttccggtaccgggtcccttaccgacgtttccgacggtaagtacggttacggacgttaacg

SEQ ID NO: 273803 - DNA, 557 bp, Homo sapiens
  misc_feature: GYAE6OF02HZ6X7.39.20.B09.1.454.CMB.1.raw
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
  modified_base (423)..(423): a, c, t, g, unknown or other
  misc_feature (423)..(423): n is a, c, g, or t
tcagtcgcactagtcacgaccggtgctcgatttagtgtagtgtgaagggagcaccgtggagaagacagtggcccctacagaatgttcataggttcccaactctaaccccacccacgggagcctggagctgcaggatcccaggggaggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggactagtcagtcaccatctcctgcactgaaccagcagnatgtgtgttanatntgtctctggtaacaacaacacccaggaccaaacgcccccaaatcatactatttatgatgtacacgtaacgactaccctgacgggtnccgtgactcgtcttcgtctcgtaccctacgaacgtcgttcggaccaaccgaccgcccttacccgacgtacccgacttaccgtcgtacgggtcccttaccgtacttcgttacgaagtacgttacggtacgttaac

SEQ ID NO: 273804 - DNA, 705 bp, Homo sapiens
  misc_feature: GYAE6OF02JPGYF.39.20.B09.1.454.CMB.1.raw
  modified_base (342)..(342): a, c, t, g, unknown or other
  misc_feature (342)..(342): n is a, c, g, or t
tcagtcgcactagtcacgaccggtgctcgatttagtgtagtgtgaagggagcaccgtggagaagacagtggccctacagaatgttcataggttcccaactctaacccacccacgggagcctggagctgcaggatcccgaggggaggggtctcgaggaggcaggcactctcggggactctccacgatggcctgggctctgctcctcctcagcctcctcactcagggcacaggactccgtgggcctcagttcctgccctagacctcagcctcgctcacgtgtccgggtctccgtggacagtcagtccactactctcctcgctactggaaacctcgacgagtcgntacggttggtcggttataacgtctcgtaccttccgttaggaaccctaaccgaaccgtaccgacggtactaaaccgaccccccgtaaatacccgttaactacctaacgttttacgtagtacgttaccgtccgtaaaccgttaaacgacccggtaaccccgttaccggtagggggttaactacccggttcgtacgttaccgtctttcccgttactacccgtccgttaccgtaaacgttcctacgggtacctaaccgaccgggttacccctccccggttagtacccccgtaaggtccctttccgggtaccggtacccggttccaaccggtttctaacccggtaggtaacgtccgggtaaacgttac

SEQ ID NO: 273805 - DNA, 554 bp, Homo sapiens
  misc_feature: GYAE6OF02GGJR6.39.20.B09.1.454.CMB.1.raw
  modified_base (324)..(324): a, c, t, g, unknown or other
  misc_feature (324)..(324): n is a, c, g, or t
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
  modified_base (464)..(464): a, c, t, g, unknown or other
  misc_feature (464)..(464): n is a, c, g, or t
tcagtcgcactagtcacgaccggtgctcgatttagtgtagtgtgaagggagcaccgtggagaagacagtggcccctacagaatgttcataggttcccaactctaaccccacccacggggagcctggagctgcaggatcccagggggaggggtctcaggaggcagcactctcgggacgtctccaccatggcctgggctctgctcctcctcaggcctcctcactcagggcacaggactccgtgggctcagtctcgcctgactcagcctcgctcagtgtccggtctccgtggacagtcagtcacctatctcctgctactacggaccngcagtgatgttggtggttataactatcgtctcgtagtacaacaccaccgaggaccaacgaccccaatcactctattactntatgtacactacgccgacctacgaggtcnctagctcgtcttctcgtcgtacctcacgtcncggacacgtaccgtccctcccagacctacgtccgttacgtccgggtaccttaccggacgttactacggtaagtacgtacggtagtaaccg

SEQ ID NO: 273806 - DNA, 920 bp, Homo sapiens
  misc_feature: GYAE6OF02FKLYX.39.20.B09.1.454.CMB.1.raw
tcagtcgcactagtcacgaccggtgctcgatttagtgtagtgtgaagggagcaccgtggagaagacagtggcccctacagaatgttcatacggttcccaactctaaccccacccacgggagcctggagcctgccagggactccccgaggggtaggggtcctcgaggagcaggtcactctcggacgtcctcccaccatcggcctggcctctgcctccctccgtccacgccctccgtcaccgtccgacgggcacgacggacttcccggtgggccttccgacgttcctccggtccccgttagacccgtacctaccgtccccgttaccgcccgttaccaccggttccggtccccggggtttaccctccccggtacgggtacccgtacgtacccgtaccgttaccaccgtaactttccgtaccgttaccgaccgtacccgttaacggaaccccgtacggccctaaggttacgtaacgttcggggttttaacgttacggtttaaactaccgtttcgttaccggttaccctaccgtaacccggtaacccgtaaacccaacccgtaccccgaaccggtaccccaaaaccccgtaccccctaacgtacctacgtaacccgttacgttaacgtccgtaaccgttaaccgtacccgttaacccgtaaccgtaacccgtaacccggttaccgtaaccggggttcctacccggtacgttacccttacccgttaccgttacccgtaccgttacccgttaaacccgtaacccggttaaccgttacccggtaacccgaaacccggttaaccccgtcccgttaccccttaccgtaacccgttacccgtaacccgtttccgacccggttacccggtacccgttacccgtaacgttaccggtaacgttaccggtaaccgttacgtaacgtttaacccgg

SEQ ID NO: 273807 - DNA, 786 bp, Homo sapiens
  misc_feature: GYAE6OF02HAZ5F.39.20.B09.1.454.CMB.1.raw
tcagtcgcactagtcacgaccggtgctcgatttagtgtagtgtgaagggagcaccgtggagaagacagtggcccctacagaatgttcataggttcccaactctaaccccacccacgggagcctggagctgcaggatcccgaggggaggggtctcgaggaggcagcactcgtcgggacgtctccaccatcggcctgggctcgtgctccctcctcacgtccctcctcctaccgtcgacgggcaaccgaggactccgtggggtcctacgtacgttccgtcgtaccctcgacctccgacgtccctcgacctcgtacggtcggttccggtcctccgtggactagtcgtacgtccgactacctccgtaccgtcgacctaccggtacggaacccagtccgtaggtacgtaagttcggttagggttacgttaacttaacgttaagttccgttaccttacccggtacgtaaacctaaaccgaaccgaacccgtaacggaaccccgaaacccgttaacccctaaccgtaccgtaactaccttaaactttacgtacgtacttacgtaaccgtaacgtaaccgtacccggtacccgtacggggtaacgggttccgttccgtaacggtaccgtttcccggtactttcggttacccgttaccgacccgttcgtaaccggttaccgttaccggaaaccctaacccgggtacccgtcccttaccccgtcgtaacccgtctacccggtcggtccggtacccttacgtacttacggtaactacggtacggtagtaccgttaacg

SEQ ID NO: 273808 - DNA, 814 bp, Homo sapiens
  misc_feature: GYAE6OF02IC6Z6.39.20.B09.1.454.CMB.1.raw
tcagtcgcactagtcacgaccggtgctcgatttagtgtagtgtgaagggagcaccgtggagaagacagtggcccctacagaatgttcataggttcccaactctaaaccccacccacgggagcctggagctgcaggatcccaggggaggggtctcaggaggcagcactctcgggacgtctccacactggcctgggactctgctcctcctcagcctcctcactcagggcacaggacttccgtgggctacagtcgtcgcctgacctcacgtcctacgctacgtagtcggtaccggtcttcgtcgtacgacgtacacggtaccacctagtccgtaccgtgtacactacgggaacctaggacctaggtacggtagttacgggtttcggtaacggttttaactaacgtttaacgtacggttacctttcgtaacgggttaacccaaaactaaccgaacccgaacgggaacccgaaaacccgtacccccgtaaaatacccgtaaacttaccgttaacgtttaacgtagttaccgttagtaaccgtaaaacttaacggcccgttaaacccgtggtaaccggggtcgttaccgtacgtacggtaaccttcgttaaccgttaccgtaccgtcccttaaaccgggtaacgttcccggtaacgggtaacccgtaaaaacccggcccgggttaacccccgtttccgaaccggttaaacccgtaacgtttacccggttaccggtaaccccgggttaaccgttaaccccgttcgggtttaaactacggaaaaccgggtttacgtaccggggtaacccgttttaaaaccgg

SEQ ID NO: 273809 - DNA, 816 bp, Homo sapiens
  misc_feature: GYAE6OF02I8UNG.39.20.B09.1.454.CMB.1.raw
  modified_base (249)..(249): a, c, t, g, unknown or other
  misc_feature (249)..(249): n is a, c, g, or t
  modified_base (378)..(378): a, c, t, g, unknown or other
  misc_feature (378)..(378): n is a, c, g, or t
tcagtcgcactagtcacgaccggtgctcgatttagtgtagtgtgaagggagcaccgtggagaagacagtggcccctacagaatgttcagtaggttcccaactctaaccccacccacggggagcctggagctgcaggactcccgaggggagggtctcgagggaggcagcactcgtacgggactctccaaccagtcggccgtggcctctcggcctcctcctcgacgccctcctcactacgagggaccacgnggtactccgtacgggcctcgtacgtccgtccgtcctggacctcgacggtccctaccgcctacggtcggttccggtaccccggtcctccgtcgggaactcggtctacggtaccaccgtacttccgtccgngacctacgtacggaaccgtgcttgtacgtattcgggtaggttacttaacgacgtttcgtcggttaacccttcgtaaccgtaaaaccgaccgtaaacccgtccggaaaccgtaaacccgaacccgtaccccctaaagtacccgtaatttacccgtaacgtttacgtacggttaattaccggttaaccgttaaaccgaccggtaccccgtaccggttaccgggtaacggtccggtaccgttcggtacgttacccgttgtttaaccccgttccgttaccgtacccggtttacgtacccgtcggttaaccaccgttacccgccgttacccgttaccgtacccggtaccgttccggttaccgttaccgggtaccggttaaccccgtacgttccggttaacggttaacgaacggttaccggtttaccggaacgtttttaaccgg

SEQ ID NO: 273810 - DNA, 718 bp, Homo sapiens
  misc_feature: GYAE6OF01BEJC0.15.11.A11.1.454.CMB.1.raw
  modified_base (218)..(218): a, c, t, g, unknown or other
  misc_feature (218)..(218): n is a, c, g, or t
  modified_base (345)..(345): a, c, t, g, unknown or other
  misc_feature (345)..(345): n is a, c, g, or t
tcagtctacgtagccacgaccggtgctcgatttagctacgactgcagggtgggtaaggaaatacctgcaactgtcagcctcagcagagctcgtcgggggagtctgcaccagtggcttggaccccactcctcttcctcaccctcctcctccactgcacagggtctctctcccagcttgtcgctgactcaatcgcctctgcctctcgcctccgtgggacncctcggtcaagctcaccgttgcactctgacgcaggtcggacaacgaccacgctaccgccagtcgcagtcggacatcgagcagcgacgccaggacgacggcctcgctacgtgagtagaacgtctaacngtcgatcgacacgccgacgaggggtaacgggggacgtacgtccgtagactcggtactttaccgcgtacggtcctaccgacgtccgtacggtcggggccttaggaccggcccgttaccgttaaccctcccgtaacccgtacggttacccgtaaccccgaccgggttccccttaacccggttaacggttaccggttaacggggaacgggttaacggttcgggtaaccggttaccgttaaccggttaaacccttttaacgggtttacccgttacgggttaacccgtaaaccgggttaccccgggtaccggggggtaaccctaccgggggttaaggtaacccggttaaagggttttacggggggttttaacgggggg

SEQ ID NO: 273811 - DNA, 615 bp, Homo sapiens
  misc_feature: GYAE6OF01DPHKJ.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctcgcctctcgccctcccgtggggacgtcctcggtacaagctccacctgccactctgagcagtcgggcacacagctacgccatcgcagtggacatcagcagcagccgaagacggaacggccctcgactactgatagaacgtactaacatagatgacacgacaacgagggtaaggggacgactaccgtgactcgtcttcgtcgacggtctaccgacgtcgtcggtcgggctacggacgtcgtacccttaccgtaccaccctagttcccgtacccgacgtccccttacgtacggttccgtaggtacggtacgtcgggtaacggtccttacggtaaaccgttttccgttaaccgttcggtacccgtacgggtaccccggtggggtacccaacggttacgggacgttaaaggttcggggtttacggggg

SEQ ID NO: 273812 - DNA, 675 bp, Homo sapiens
  misc_feature: GYAE6OF01DCX1P.15.11.A11.1.454.CMB.1.raw
  modified_base (214)..(214): a, c, t, g, unknown or other
  misc_feature (214)..(214): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctcgccctccgtgggacncctcggtacaagcctccacctgcctactctgacgcaggtggaccacaccagcctaccgcctatcgcagtggcactcagcagcgacgccgaaggacggaaccgggtccctacgtacttaacgttacgataggaacgttaccttaaacgtacgtagtacggtacggaccacgaaccgaacggtaacggggtaaacggggggaccggtactacccgtagtaaccgtcccggtacctcccgtacgacggtccctccgacggtcgtcgggtcggggctacggaccggtcctacccgtaccgaccaccgtacttcccgaccgtaaccgtccccgttacgacgttcgtagggtacggtacgtacgggacggtaccgttaggtaacctttaacgttcggtacgtacccggaacggtaccgggtacgggtacctaacggtggtaacgttaagggtttgggttacgggggg

SEQ ID NO: 273813 - DNA, 538 bp, Homo sapiens
  misc_feature: GYAE6OF01B22N2.15.11.A11.1.454.CMB.1.raw
  modified_base (321)..(321): a, c, t, g, unknown or other
  misc_feature (321)..(321): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcacctgcactctgagcagtggcacaccagctacgccatcgcatggcatcagcagcagccagagaacgggccctcgctactgatgaacgcttaacnctgatggcagccacgaggtaacgggggacggactcccgtgactccgtcttcgtcgacggcctcgagtcgtcggtggggctggacgccgcctacctcacctactcctaccacgtccctaccgacgttctaggacggtatcggacggtcctagtaccgttacgttactcggtcacggtaccggtcggggacctacggtaggactaggttgggttcgggg

SEQ ID NO: 273814 - DNA, 695 bp, Homo sapiens
  misc_feature: GYAE6OF01BQMK2.15.11.A11.1.454.CMB.1.raw
  modified_base (216)..(216): a, c, t, g, unknown or other
  misc_feature (216)..(216): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacaggtctctctcccagcttgtgctgactcaatccgccctctcgcctctcgccctcccgtgggacnccgtcggtcaagcctcacctgccactcgtgacgcaggtcggacacaccagcctacgccatcgcagtcggcatcgagacgagacgacgaccaaggacggaacgggcccctacggtacttacgttgagtagaactaccttaacacgtgagtcggactacgaccgaacgaagggtaacgggggacgtacgtccgtacggtacgttccgtacgttcgacgtacggtccttaccgacgtccgttaccggtcggggacttacggaccgtcccggcccttaaccccgtaccgaacccttacgttaccctacccgtaacccgtcccctaccggttaaccggtttccggaaccgggtaggttaaccgtagggaaccggtacccttaaggtaacctttaccgtttaaccgtacggttaccgaccgggtacccgggttcggggtaccttaccgggtaggtaaccgttaagggtttcggggtttacggggg

SEQ ID NO: 273815 - DNA, 665 bp, Homo sapiens
  misc_feature: GYAE6OF01EIJL8.15.11.A11.1.454.CMB.1.raw
tcagtctacgtagccacgaccggtgctcgatttagctacgactgcagggtgggtaagaaatacctgcaactgtcagcctcagcagagctctgggggagtctgcaccatggcttggaccccactcctcttcctcaccctcctcctccactgcacagggtctctctcccagcttgtgctgactcaatcgccctctcgcctctgccctcccgtgggacgcctcggtcaagctcacctgcactctgagcagtggcacaccagcctacgccatcgcagtcggcatcgagacacgcacgccgaggacggaacggccctcgctacgttgactagaacgtacttaacacgtagacgtcggacgtacggacccgaaggtaacggggtaaacggggggaccggtacgttacccgtagtacgttccgtccgtttaccgacgtacgggtccctaccgacggtcgttccggtggggtaccttcggaccgtccgtacccttaacccgtacccgtaacctacgtccctacccgtaccgtccccgtaccgtacggttccgtaggtacggtacgtacgggacgtaccgtagttaaccgttaacgtttaccgtacggttaccgaccgggtaccggtacggggtacctacgggtaggtaacggttaaggttggggtttacgggg

SEQ ID NO: 273816 - DNA, 639 bp, Homo sapiens
  misc_feature: GYAE6OF01BUKMQ.15.11.A11.1.454.CMB.1.raw
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (500)..(500): a, c, t, g, unknown or other
  misc_feature (500)..(500): n is a, c, g, or t
  modified_base (517)..(517): a, c, t, g, unknown or other
  misc_feature (517)..(517): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctcctcccagcttgtgctgactcaatccgccctctcgcctctcgccctcccgtgggacgtccgtcggtacaacgctccacctgccactcgtgacgcgaggtcggccaaccaccgacgtccgtaccgccaagtccgactagtggacactacgacgacagccaacgaccgaaggaacggaaccggtccctacgtactacgttagagtacgaacgttaccttaaacgacgttagagtcggactaccgaacgagaacggggaaggggaccgtactccgagtacgtcgttctccgacgacggtccctacgnggtaccncgggtcgggctggccgtccgaccctacnccgtaacctacgtcccncgtacccgtcctccgtaggtcncgggtangtggacgttccgaagttacgtaccttaggtcgtaaccggtacgtccggggtacgtacctaagtacggtaacgttagggttgggtttacggggg

SEQ ID NO: 273817 - DNA, 649 bp, Homo sapiens
  misc_feature: GYAE6OF01B9RGY.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacaggtctctctcccagcttgtgctgactcaatcgccctctcgcctctcgcctcccgtgggacgcctcggtcaagtcctcacctgctactctgacgcgaggtcggcacaccagcctacgccacgtcgcagtcggactactcacgcacgcacgaccgaaggacggaacggccctcgaccttacgttagagtacgaacgtacttaacgacgtagacgtcggacacgaccgaacgtaacggggtaaacgggggacggtaacgtcccgtaggtaccgtccgtaccttcgacggtacgggtccctaccgacggtccgtcggtcggggactacggaccgcgtaccctaccctacgaccctacgtccctaccgaccgtcccgtactacggttcgtaggacggtagtcggaacgtcgttaacgtacgttacttacggtcgtaccgacgttaccgggtacgggtaccaacgggttaggaacccgttaagggttcgggtttccgggggg

SEQ ID NO: 273818 - DNA, 560 bp, Homo sapiens
  misc_feature: GYAE6OF01A4Z0F.15.11.A11.1.454.CMB.1.raw
  modified_base (213)..(213): a, c, t, g, unknown or other
  misc_feature (213)..(213): n is a, c, g, or t
  modified_base (368)..(368): a, c, t, g, unknown or other
  misc_feature (368)..(368): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgccctccctgggacncctcggtcaagctcacctgcactctgagcagtgggcacaccagctacgccatcgcatggcatcagcagcagccagagaacgggccctcgctacttgatgaagcttaacactgatggcagccacgaggtaagggggcggatccctgactcgcttcncgaggctcgagttcgtggggctggacgccgccaccctcgtcactcctccgacgtcccgtccagttccgtaggacgggtagtcgggagggttgtaaccgttaagtttacgtttcggttacgacgggtacgggttacgggggtcctaaggggttcggtaccggtttacgagggtccgtaggtttacccgggggg

SEQ ID NO: 273819 - DNA, 690 bp, Homo sapiens
  misc_feature: GYAE6OF01CWOVI.15.11.A11.1.454.CMB.1.raw
tcagtctacgtagccacgaccggtgctcgatttagctacgactgcagggtgggtaagaaatacctgcaactgtcagcctcagcagagctctggggatctgcaccatggcttggaccccactcctcttcctcaccctcctcctccactgcacaggtctctctcccagtcttgtgctgactcaatccgccctctcgcctctcgccctcccgtagggacgtcccgttcggtacaacgtcctaccaccttcgcctaccgtcgtggaacgcgtaacggtcgggaccaccgaaccgacgaccgtaccggacctacgtccgacgtacgtcggactactaccgacgacgacgaccgaacggtaccgaaggaaccggaaccggtcccgttacgcgttacgttacgacgtacgaacgtactaacgacgtagtagtcggacgacgaccgtaacggtaacgggtaacggggtacgtaccgtaccgtacgtacgtcccgtacttacgtacggaccgtcttaccgaggtctacgggtcgggtctaggaccgtcctacctaccgacctaccgtctccgtaccgccgtacctcgaacgttcgtaggactacggtcgtaacggtccttagtaacgtttcgttaacgcggtaacgacggttaccgggcggtacttacggtacggtaagtacgggtttggttacggggg

SEQ ID NO: 273820 - DNA, 687 bp, Homo sapiens
  misc_feature: GYAE6OF01C4JYR.15.11.A11.1.454.CMB.1.raw
  modified_base (199)..(199): a, c, t, g, unknown or other
  misc_feature (199)..(199): n is a, c, g, or t
tcagtctacgtagccacgaccggtgctcgatttagctacgactgctaggggtggggtaagaaatacctgcaactgtcagcctcagcagagctctggggagtctgcaccatggcttcggaccccactcctcttccttcaccctcctcctccacttgcacagggttctactctcccagcttgtgctgactcaatcgccctntcgcctctgccctccgtgggacgcccgtcggtacaagcctcacctgctactctggacgcgtacggtcggaccaccgaccacgtaccctaacgccgtagtccgacgacgtcggactactcgagccgacgcgacggaccgaggtaacggtaacgggtccctcgtacttacgttagatacgtaacgtaccttaacgacgtcgaacgtcggacgacgaccgacggtaagggaacggggacgtactaccgtagacgtcgtacttccgacccggtctacccgtagtccgttcggtacggactacggacgtccgtctaacccgtccaccgtactcccgtaccgtcgtaccccgttagtacgttacgtacgggaacggtggtacgggacgtacgtacggttaaccttaccgttaacggtacggttaccaccggtaccgggttacgggccgtaacggttagggacgtttaaacgggttgggttcggggtacccgggg

SEQ ID NO: 273821 - DNA, 596 bp, Homo sapiens
  misc_feature: GYAE6OF01EIQGF.15.11.A11.1.454.CMB.1.raw
  modified_base (284)..(284): a, c, t, g, unknown or other
  misc_feature (284)..(284): n is a, c, g, or t
tcagtctacgtagccacgaccggtgctcgattttagctacgactgcagggtgggtaagaaatacctgcaactgtcagcctcagcagagctctgggggagtctgcaccatggcttggaccccactcctcttcctcaccctcctcctccactgcacagggtctctctcccagcttgtgctgactcaatcgccctctgcctctcgcctcccgtgggacgcctcggtcaagcctcacctgcactctgacgcagtggacacaccagcctacgccatcgcatcggcatcngcacgcagccagacgaacgggcctgctacgtgatgaagtacttaacacgtgagtcgacacgaccgaaggaacgggtaagggggaccggtacgtccgtagacgttacgtcgttcacgacggtctaccgcgtcgtcggtcgggtctacggcgtccgtacctaccctacaccgtcgtcctaccgtaccgtcccttaccgacgtcgtaggacggtacgtagtacggtcgtagttaaccgttacgtttacgcggtaccgtaccggtaacggtccggggtactacggtaggaccgttaaggttggggtttaccggggg

SEQ ID NO: 273822 - DNA, 696 bp, Homo sapiens
  misc_feature: GYAE6OF01CLKH2.15.11.A11.1.454.CMB.1.raw
  modified_base (213)..(213): a, c, t, g, unknown or other
  misc_feature (213)..(213): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgccctccgtgggacncctcggtcaagctcacctgcactctgagcagtggcacaccagctacgccatcgcatggcatcagcagcagccagacgaacgggccctcgctacttgatgaacgtacttaaacacgtagatcggacaacgccaacgagggtaaggggggaccggtaactcccgtaggaacttccggtcctttaccgtacggaacgggtcccttaccgaacggtccgttccgggtacgggggtccttacgggacgtcccgtaccctttaacccgtacccaacccgtaactttcccgtaaccccgtaaccgtccccgttaccgtaacggtttcccgtaagggacgggtaaccttcggggaaccgggtacctttacgggtaaccgtttaaacggtttacccgtagggttacccgtaacggggtaccccggttacgggggtacccttaaccgggttagggtaacccgttaaaagggttttcgggggtttaccgggggg

SEQ ID NO: 273823 - DNA, 754 bp, Homo sapiens
  misc_feature: GYAE6OF01DJ4SM.15.11.A11.1.454.CMB.1.raw
tcagtctacgtagccacgaccggtgctcgatttagctacgactgcagggtgggtaagaaatacctgcaactgtcagcctcagcagagctcgtggggagtctgcaccatggcttcggaccccactcctcttcctcaccctccctcctccactgcacgaggtcctctcctcccagtcctttgtcgctcgacctacaactccgccctctcgcctctccgccctccgtaggacgtcccgttcggtacaacgtcctaccgaccgtcgacctaccgttcgacgacgcgtacggtcggaccaccaccgtacgccgtaccgcctacgtccgacgtacgtcggactaacgcgacgaccgacgacgaccggaccgaaggaccggaaccgggtccctcgtaacttacgtagaacgtacgtaacgtactaacgacgtagtacgtcgacgacgaccgaggtaacggggaacgggtaccgtacgtaccgtagtacgtccgtacttccgtcgtaccgtccgtaacgtcggtccggtccgggtacgggtcgtacgggacccgtccgtaccccgttaaccgcccgtaaccgttacccgttccccgtaccccgtacccgtcccgttacgtacgtaccggtaagggtacgtacggttcggaccgttccgtaacgtttaacggttccgttacgttaccggtaccggttaacccgggtacggtcggtaccgtaacggttacggtaaccggtttagggtttccggggttacggggg

SEQ ID NO: 273824 - DNA, 689 bp, Homo sapiens
  misc_feature: GYAE6OF01AUP8U.15.11.A11.1.454.CMB.1.raw
  modified_base (178)..(178): a, c, t, g, unknown or other
  misc_feature (178)..(178): n is a, c, g, or t
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (386)..(386): a, c, t, g, unknown or other
  misc_feature (386)..(386): n is a, c, g, or t
tcagtctacgtagccacgaccggtgctcgatttagctacgactgcagggtgggtaagaaatacctgcaactgtcagcctcagcagagctctggggagtctgcacctatcggcttcggacccccactcctccttcctcacccctcctcctccactgcacaggtctctctccagtcttgnctgactcaatccgccctctcgcctctcgcctcccgtgggacncctcggacaagcctcacctgctactcgngacgcaggtcggcaccaccgacgcctaccgccacgtcgacagtcggcactcacgcacgacgacgaccgaggacggaaccgggccctacgtacttacgttggacgtaggtaacgtccttaacacgttagacgtccgganacgaccgtaaacggaaggggttaaacgggggacggtcgttacccgtagtaccgttcgtaccttcgtaccggtacgtcccgtaccgtggtcccgttacgggtaccgggtagtaccggaccgtacccgttacctaacccgtaccacccgttaatcccccgttaacgaccccggttcctacccggtaggttccgtaacgggacgtaaggttcgaccgggttataaccggtactttaacggtcgtacggtcggaccgtaccgggtacggtaacctcgtaggtaaccgttaaggtttcgggtacgggg

SEQ ID NO: 273825 - DNA, 774 bp, Homo sapiens
  misc_feature: GYAE6OF01D0ZKC.15.11.A11.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (743)..(743): a, c, t, g, unknown or other
  misc_feature (743)..(743): n is a, c, g, or t
tcagtctacgtagccacgaccggtgctcgatttagctacgactgcagggtgggtaagaaatacctgcaactgtcagcctcagcagagctcgtggggagtctgcaccatggcttcggaccccactcctcttcctcaccctcctcctccactgcacgaggtctctctccagtcttgtgctgactcactcgccctntcgcctcgtcgcccttccgtgggacnccgttcggtacaacgtcctcctacctgacctactcgtgacgcgtacggtacggcaaccgaccgacgccgtaaccgccaacgtccgactaacgtcggacctagtaccgacgtaccgaaggaccgacggtaccgaaacggaaccgggtaaccgggtccctacgggtaccttacgtagacgtaacggtaacgtacgttaaaccgacgtacgtaacggtcgaaccgacgacccggtaaaggaaacgggggtaacgggggtaccgtaactcccgtagggtctacccgtcttaccgacggaccggttctaaccgtgttccgttacgggtcgggtaccgtagtacccggccgttaccctacccttaacgacccgttaacgttcccgaacccggtacgtccccgttaccgtaggttacgtaacggggtaacgtacgtaacggggccgtttaaaccgttaacggtaacgttttaaccgttcggacggttaacggtcccggtacccgggttagggaccttacgggttaaccggngtttaaaccggggttggggttaacccggggg

SEQ ID NO: 273826 - DNA, 931 bp, Homo sapiens
  misc_feature: GYAE6OF01D9BK9.15.11.A11.1.454.CMB.1.raw
tcagtctacgtagccacgaccggtgctcgattttagctacgactgcagggtgggtaaagaaatacctgcaactgtcagcctcagcagagctcgtgggggatctgcaccagtggtcttcggaccccactcctcttcctccaccctcctcctcactgcacgaggtctctcctccagtcgttgtgctcgactcactccgtcctctcgtccttcgtccgtcccgttccggtgggaccgtccgtacggtaccgaacgtcctaccgtaccgtcaccgtacgttcgtacggacgacggtacggccggaccaccgaccgacgtaccgtaccgacctacgtaccgacgtacggtaccggactacgtaccgacggaccgacgaccgacggaaccggaagggaaccgggtaaccggtcccgtacgttacgttacggtacgtacgtaacgtaacgttacgtaacgtacgtacggtacgtacggaaccggtaccggaaccggtaaacggggaacgggggtaaccggggtaccgtaccgttaccgtacggttaccttcccgttacgttaccgacggtacggttacccgtcgtaaccgggttcggtccggggttacgggtaccgtaccgggttacccgtaacccgttaccttacccgtaccccgtaaaccgttcccttaaccccgggtacccgaacccggtttaccccgttaacggggttaccggttaacggggtaccggtaaacgggtttccggaaaaccgggttccggttttaaacctttaacccgggtttaaacgtttttaacccggttaccgggacccgggtttaaaacccgggtccgggggtttaaccccgggtaccgggttaaaaccggttacggggtttaaaacccgggtttaaacggggttttcccgggggggttttgggggttaaaccccggggggg

SEQ ID NO: 273827 - DNA, 618 bp, Homo sapiens
  misc_feature: GYAE6OF01DY490.15.11.A11.1.454.CMB.1.raw
tcagtctacgtagccacgaccggtgctcgatttagctacgactgcagggtgggtaagaaatacctgcaactgtcagcctcagcagagctctgggggagtctgcaccatggcttggaccccactcctcttcctcaccctcctcctccactgcacagggtctctctcccagcttgtgctgactcaatccgccctctcgcctctcgccctcccgtgggacgcctcggtcaagctccacctcgccactctgagcgaggtcggacaccaccagacctacgccatcgcagtcggcactcgacgcacgacgacgaccgaaggaacggaaccgggccctacgtactacgtaggactacgtaaacgtaccttaaacacgtagacgtacggacgtacgaccgaaacggaagggtaaacgggggacggtaccgtccgtagtacgtcgtcgttcgacgtacggctccgacgtcgtcggtcgggtctaggccgtaccgtaccctacctacaccctacgtcctaccgccgtccctacgtacgtcgaggtacgacgtggacgtcctagtaacttacgttcgtacgtcgacggtccggaggtaccgagtaggtaacgtaggttcgggttcgggg

SEQ ID NO: 273828 - DNA, 647 bp, Homo sapiens
  misc_feature: GYAE6OF01CWXGB.15.11.A11.1.454.CMB.1.raw
  modified_base (125)..(125): a, c, t, g, unknown or other
  misc_feature (125)..(125): n is a, c, g, or t
  modified_base (163)..(163): a, c, t, g, unknown or other
  misc_feature (163)..(163): n is a, c, g, or t
  modified_base (175)..(175): a, c, t, g, unknown or other
  misc_feature (175)..(175): n is a, c, g, or t
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (387)..(387): a, c, t, g, unknown or other
  misc_feature (387)..(387): n is a, c, g, or t
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
tcagtctacgtagccacgaccggtgctcgatttagctacgactgcagggtgggtaaagaaatacctgcaactgtcagcctcagcagagctcgtaggggatctgccaccatcggcttcggaccccnctcctcttcctccaccctcctccctccactcgcaacgnggtcctcctccncccgagtcttgcgctnacctcaactcccgcctctcncccttcgctcccgtacccgtgggaccnccgttacggacaacgtcctacaccctgacccatccgagaccgacgtaggacggacaccacgacgacaccgacctnccgangcgacngtcagcagaccagacaaggacggtaccggcctcggtactagtagagtagaaccacttaaacgngagatacgacgacgacgaagggaacggggtaacggactactacgtntacgtcctacgtcgacgaccncgtacgtacgtccgtggtacggcacggctacctaccaccacaaccgtctcccgactccaccgtagacggtagtacgaggtactacgggtaccgtactaacgttaacgttaccgtaggtaccggtaacgtacccgggtacgggtaaccgtaccggaacgtttaaccggtaggttacgggttacgggggttccgg

SEQ ID NO: 273829 - DNA, 833 bp, Homo sapiens
  misc_feature: GYAE6OF01DYKUQ.15.11.A11.1.454.CMB.1.raw
tcagtctacgtagccacgaccggtgctcgatttagctacgactgcagggtgggtaagaaatacctgcaactgtcagcctcagcagagctctggggatctgcaccatggcttcggaccccactcctcttctccaccctcctcctccactgcacaggtctctcctcccagtcttgtgactgtactacgaatccgccctctcgcccttcgtcgacccgtccgtacgggcgtccgtccgggtacaacgtcctacctaccgtcgcctaaccgttcgtacggacgtacggtaggtacgggaccaacccgtaccgacgtacccgtaccgacctacgtccgacgtacgtcggtactacgtaccgaacggaccgaacggcgaaccggacccggtaaggaaccgggtaaccgggttccctacggtaccttacggttacgaacgttacggtaacgttaccgttaaactaccggtagacggttaccgaacgaccggtaaccggaacgggtaaagggggtaaccggggaccgtaactcccggtagtaccgtccggttccttacgacggtaccgtccctacggtacgttccggaccgggttgggcctaccgggtaccgacccttaacccgtaccgtaccctaaccgtccgttaaccctacgtacccgttaccctaccgggttactacgggaacgggttacggcggttaaccggtacgttaccggttaaaccttcgtttaaaaccggttcgtacgggaacccgttaacccggggtacggtaccggggttaccttaaacggggtaccggttaaacggtttcggggtttacggggttttaacccgggggg

SEQ ID NO: 273830 - DNA, 703 bp, Homo sapiens
  misc_feature: GYAE6OF01CP814.15.11.A11.1.454.CMB.1.raw
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
  modified_base (552)..(552): a, c, t, g, unknown or other
  misc_feature (552)..(552): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctctcctcaccctccctcctccactgcacagggtctctctcccagcttgtgctgctcaatccgccctctgcctctcgcccttcccgtggggacnccgtcggtacaagctcacctgcactctgagcgagtcgggcacaccgagtcctaacgcctanccgtacacgtggaccagtccaaggccaaggcccacggacccgaaggaacgggaaccgggccccttacgtaccgttacgtttacggaatacggtaacggtaacttaaacgtaacgtagggtacacgggtaccgaacggacccgaacgggtaaacggggtaacgggggggtaaccggtaccgttcccgtaaggacgttccgtcctttaccgtcgaacgggtcccttaaccgcgttcgtcgggtaccggggtcttacgggccgtacgccgttaaccnccgtacctacgttccgtaccctacggtccctacgacgtcgtacggtacggagtttcggacgtacgttacgacgtttacgttaggacgtacggtacgggtaaccggttgggtaaccgtacggtagtaacggttaggttgggtttaacggggg

SEQ ID NO: 273831 - DNA, 996 bp, Homo sapiens
  misc_feature: GYAE6OF01ECI8G.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatccgccctctgcctctgccctccgtgggacgcccttcgggtacaacgtcctccaccctgacctactctaggagcgaggtcgggaccaaccaccgacgccgtaaccgacctaacgtccgacgtaacgttcgggacctaacgttaccgaacggtcccgaacgggaccgaaaccggaccccggaaaggggtaaacggggaaaacccggggggtccccccttaccggttaaccgtttaaccgtttacggaaacgttaacgggtaaaccggttaacccttttaaaaaccgtaacccggtttaagggtaacggtttacccgggggaacccttaaccggtaacccccggtaaacggggaaaaccggggggtttaaaacgggggggggaaaccccgggtacccgtttaccccgggttaacggtaaccggtttacccgggttaccccggttttaccgtcccgggtaaaccgggtaccccgttacccggtaaacgggtttcccggttaccggggttaccggggggtaccgttacggggtaacccggtaccccgttacccggtttaaccccgttaccccgtaaaccccgttacggttacccccgttaccccggtaacccgttccccggttaacccgtacggtttacccggttaagggtacgggttaacgttcgggaaacgggtttacccgttaacggttaaccgtttaacggtttaaccgttcggttaacccggtaacccggggttaaccgggttcccggggtaactaaacccggggttagggttaaaccgttaaacggggtttgggggttttacccggggggg

SEQ ID NO: 273832 - DNA, 815 bp, Homo sapiens
  misc_feature: GYAE6OF01A62GC.15.11.A11.1.454.CMB.1.raw
  modified_base (173)..(173): a, c, t, g, unknown or other
  misc_feature (173)..(173): n is a, c, g, or t
tcagtctacgtagccacgaccggtgctcgatttagctacgactgcagggtgggtaagaaatacctgcaactgtcagcctcagcagagctctggggagtctgcaccatggcttggaccccatcctcttcctcaccctcctcctccactgcacgaggtcctctctccagtcttgngctgactcaatccgccctctcgcctcgtcgccgtcccgtgggacgtccgtcggtacaacgtcctaccgaccgtcgcctacttcgtagacgcgtaggtcggaccaaccaccgacgtccgttaccgacctacgtaccggaccgtaacgtcggctaacgtccgaacgtaccgacggccgaccgtaccgaagggaaccgggaccggtccctaccgtaccgttacgtagtaacgtaacggaacttaacctaaacgtacgtacggtacgtacgggacgaacgtaacccggaagggtaaacgggggtaaaccggggggtaccgttacccgttaacccggttagggtaacccttccggtttaccgttaccggtaccggtaaccggttccctacccggtacggttcccggttaacggggtcgggtaccgttaaccgggccgttacccgtacccgttaaccccgtaccgtaaccgttacccgtcccgaaccccggttaacctccccgttaaccggtacgtttacggacggtaacggttcgggtacgtaccgggtacctttaacgggtacttaacggttccgtaacggtacgaccgggttacggacccggtaactacggttaaccggtagtttacggggttcggggttacggg

SEQ ID NO: 273833 - DNA, 766 bp, Homo sapiens
  misc_feature: GYAE6OF01DKZTA.15.11.A11.1.454.CMB.1.raw
  modified_base (174)..(174): a, c, t, g, unknown or other
  misc_feature (174)..(174): n is a, c, g, or t
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagtctacgtagccacgaccggtgctcgatttagctacgactgcagggtgggtaagaaatacctgcaactgtcagcctcagcagagctcgtggggatctgcaccatggcttggaccccatcctcttcctcaccctcctcctccactgcacgagggtctctcctccagtcttgnactgactcaacgtcgcccttntcgccttctcgcctcccgtggggacncccgtagggtacaagcctaccaccgtgaccactcgtagagctaacggtcggaccaaccaaccgtaggtcctaccgactacgacacgaagttcggactaacgtaccgagaacgtacgacgaccggaaccgaggtaaccggaaccggtccttcggaacgtttacgtaggaagttaacgaaacggttacctaaaccggtgttaacggaaggtcgaaccgtaacggaaccgaacgggaaagggggtaacggggtaccaacgttcccgtaagtacgtaccgttacgttacaccgggtaacggtccccttacggacgtacggttcccgggttagggccgttaaacggcgtacccgtaaccgtaaccccttcgaaaccgtaaccgtttcccaacggtaccgttacccgtacgaacggtttcgaaagggagggtaccgttaggacggtttacctaaacgttaaacgtttaccgttaacggacggtccgtaaaccgggtaacggtcgggtaaaccctacggttaggtaactaaggggtttacggggttacgggg

SEQ ID NO: 273834 - DNA, 695 bp, Homo sapiens
  misc_feature: GYAE6OF01AO998.15.11.A11.1.454.CMB.1.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (588)..(588): a, c, t, g, unknown or other
  misc_feature (588)..(588): n is a, c, g, or t
tcagtctacgtagccacgaccggtgctcgatttagctacgactgcagggtgggtaagaaatacctgcaactgtcagcctcagcagagctctggggatctgcaccatggcttcggaccccactcctcttcctcaccctcctcctccactgcacagggttctctcctccagcttagtgacttgactcaatccgccctctcgcctctcgcctccgtgggacgcctcggtacagcctcactcgcactcngagcgngtcggcacaccgctcgtaccgcagtcgcagtggaccatccgagcaagcgacgtaccaaggaccggtaaccggtccctcggtaccttagttacgaacgttaacggaaaccgttacgttaaaccacgttagtaacgcggactacggtaccgaaacggaacgggggtaacgggaaccgtcctaacgttcggtacttacgccgtttaccgaccggcgtcccgtaccgaacggtccgtccgggtgggtacccgtcggacgccgtcccttaccgccaaccttccgtaaccgtccgaaccggtcccgtaccgacgttacgtacggtaccggtaagttcccgggngtaacccgttaagtaccggttaaacgttttccggacggttccgtacggggttccggacgggtaaccttcgggtaccggtaagttaaccgggtggggttttacggggg

SEQ ID NO: 273835 - DNA, 615 bp, Homo sapiens
  misc_feature: GYAE6OF01CAF8G.15.11.A11.1.454.CMB.1.raw
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (472)..(472): a, c, t, g, unknown or other
  misc_feature (472)..(472): n is a, c, g, or t
  modified_base (498)..(498): a, c, t, g, unknown or other
  misc_feature (498)..(498): n is a, c, g, or t
tcagtctacgtagccacgaccggtgctcgatttagctacgactgcagggtgggtaagaaatacctgcaactgtcagcctcagcagagctctggggagtctgcaccatggcttcggaccccactcctcttcctcaccctcctcctccactgcacagggtctctctccagtcttgtgctcgactcaactccgccctctcgcctctcgccctcccgtggggactccgttcggtacaacgcctcacctcgcactcgtgagctagngggcacacgagcctacgcctancgcacgtggacacgtcagacacggccaacgccgaaggaacggaacgggcccctacgtctaacgttgaagtgaaactcgttaacacgtgaagtcgacacgtaccgaacggtaaagggaacgggggtagtaccgtcccgtaggtcgtcgtacctttcgtacgagccttccgagtccgtacggtcggggtcngaccgtcgaccttacccacgaacctntccctaccgacgccctactacggtctaggaacgtgtacgggatccgtagtacgttactacgtacgtcgtaaccgcggtccggtatacccggaggtaacctagggttgggttacgggg

SEQ ID NO: 273836 - DNA, 873 bp, Homo sapiens
  misc_feature: GYAE6OF01D94CU.15.11.A11.1.454.CMB.1.raw
tcagtctacgtagccacgaccggtgctcgatttagctacgactgcagggtgggtaagaaatacctgcaactgtcagcctcagcagagctcgtgggggatctgcaccatggcttcggaccccactcctcttacctccaccctcctcctccactgcacgaggttcctctccgtacccagtctttgtgcctagacctacgactccgtccctctcgtcctcgtccgtcccgttccggtagggaccgtccgttacggtacaaccggtccttacccaccgttcgcctacgttcgtcggacggtacgtacggtccggaccctaaccggaccacgtaccgtaccgtaccgacgtaccgactagggtacggtaccacggtaccggacgacgaccgaacgaccggtaccggaagggaaccgggtaccccggccgttacgtaccttacgttagaacgtacgtaacgaacttaacgtagtaggagttaccggacgtaccgaaccgaagggggtaacggggtaacggggtcctaacgtcgtaacgtccggttccgttacgtttcgacgtaccgttccgacgtcggttacggcgtcgggtacgtacggccgtaccgttaaccctccccgttaacacccgtttacccgttacctaaccccggtcccggtaccccgttacggttaccgggttaaccggtacgggacggggttaaacttccggggtaaaccccggtttacgggttaaacccttaaccgggtttacgtttacccgggaaaccggggttaccctaacccggggttttaacccgggaaccggggttaccggaaacggtttacgggttttaaaaccgggttttcgggggtttaaccggggggtttacccggggg

SEQ ID NO: 273837 - DNA, 711 bp, Homo sapiens
  misc_feature: GYAE6OF01BRVW7.15.11.A11.1.454.CMB.1.raw
  modified_base (156)..(156): a, c, t, g, unknown or other
  misc_feature (156)..(156): n is a, c, g, or t
  modified_base (177)..(177): a, c, t, g, unknown or other
  misc_feature (177)..(177): n is a, c, g, or t
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (576)..(576): a, c, t, g, unknown or other
  misc_feature (576)..(576): n is a, c, g, or t
  modified_base (601)..(601): a, c, t, g, unknown or other
  misc_feature (601)..(601): n is a, c, g, or t
tcagtctacgtagccacgaccggtgctcgatttagctacgactgcagggtgggtaagaaatacctgcaactgtcagcctcagcagagctctggggagtctgcaccatggcttcggacccccactcctcttcctccaccctcctcctccactgcacnggtcctctctcccagtcttgngctgactcaactccgccctntcgcctctcgcccgtcccgtgggacncccgtcggtacaacgcctccacctcgccacctcgtggacgcgaggtcgggaccaaccgaaccacgaccgtccgaccctacgtcccgacagtcggaccactaccgacgcgacgaccgacgaccggaacgggaacggtaccgggccccttacgtaccttacgttagtacgtaaggaaccgttaactaacgtacgtacgtaggtccggactaccgaaccggaacggtaacgggggtaaacggggacgtaccttccggtacgtacgttccggtacttaccgacggtccggacctcggcgtacgtccgggtgggtcgtacggaccgtccgttaccctccgtacctacctccggtaccnccgtaccgtccctacggttacggtnacgggtacgtcgacggtcgtaccgtaataccggtttacgttcgtacggtacacccggggttaccgtggaaccgttcgggttagaacggttttagggtggggttaccgggg

SEQ ID NO: 273838 - DNA, 554 bp, Homo sapiens
  misc_feature: GYAE6OF02GGU17.15.11.A11.1.454.CMB.1.raw
  modified_base (367)..(367): a, c, t, g, unknown or other
  misc_feature (367)..(367): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacgaggtaagggggacggatcccgtgatcgctttcncgaggctccgagcctcgtggggcttggacgcgcctacctcaccatcctccacgtccctccgagttccgtaggacggtatcggaacggtcttaggtaacctttaagtttaccgtacggttaccgaacggtaacccggttgggggaccctaacggttcgggaaccgttaaggttaggggtttacggggg

SEQ ID NO: 273839 - DNA, 587 bp, Homo sapiens
  misc_feature: GYAE6OF02IOJ4U.15.11.A11.1.454.CMB.1.raw
  modified_base (481)..(481): a, c, t, g, unknown or other
  misc_feature (481)..(481): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgccctccctgggacgcctcggtcaagctcacctgcactctgagcaggtggcacaccagctacgccatcgcatggcatcagcagcagccagagaacgggccctcgctacttgatgaacgtcttaacactgatggcagccaagaggtaacgggggacggactccgtgatccgcttctacgaggtcctaccgagtcctggtaggggccttggacgcccgtacctacccgtacacccgtattcccgtaccgacgtccccgttactaacggttccttagggaacggtntacgggtacggccgttaggtaccgttaactttccggtgtaacccgaacggcccggtttacgggggacctaccggttaggcccttaaagggtttcggtttacggggg

SEQ ID NO: 273840 - DNA, 492 bp, Homo sapiens
  misc_feature: GYAE6OF02H59QZ.15.11.A11.1.454.CMB.1.raw
  modified_base (319)..(319): a, c, t, g, unknown or other
  misc_feature (319)..(319): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagcctacgccatcgcatggcatcagcagcagccagagaaggccctgctacttgatgaagcttaaacnctgatggcacgccaacgagggtaaggggggacggactcccgtgactcggtctttcgtcaggcctcacgctcgtgggctgagcgcctacctcaccntcctccagccctcagtcnggacgagtgagtctagactnttactgtacacgccgtgggcacgtggactagtaggttggg

SEQ ID NO: 273841 - DNA, 539 bp, Homo sapiens
  misc_feature: GYAE6OF02GN3RO.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcaggtgggcacaccagctacgccatcgcatggcatcagcagcagccagagacgggccctgctacttgatgaagcttaacactgatggcagaccaacgaagggtaagggggaccggtactcccgtgacgtcgtcttcgtacgacggtcctccgaggtcctcggtcggggcttggacgccgtcctaccctcacctactcctaccacgtccctccgtagtccgtggagtagcggagtactagtacgttagttactcgtacgacgtccgtcggggctaccggtgggtactaggttaggttcggg

SEQ ID NO: 273842 - DNA, 632 bp, Homo sapiens
  misc_feature: GYAE6OF02GNML5.15.11.A11.1.454.CMB.1.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcactagggtctctctcccagcttgtgctgactcaatcgccctntgcctctgcctccgtgggacncctcggtcaagctcacctgcactctgagcagtggtacaccagctacgccatcgcagtggcatcagcagcagccaggagacgggcctcgctactgatgaacgcttaacatgatggcagcacgagggtaacggggacggtactcccgtagacgtccgtacttcgtacgacgggtacctaccgagtccgttcggtcggggcttagggacgtccgtaccgtaacccgtcaacccgtacttcccgtacccgaacggtccccttaccgaacggttccgtaacgggaaggttactacgggacgtaccgttacggtaaccgtttaagtttacccggtacgttaaccgtaaccggtacccgggtttacgggggaccttaacgggttacgggtaacctaaacgggttttaggggttcggggttaccggg

SEQ ID NO: 273843 - DNA, 531 bp, Homo sapiens
  misc_feature: GYAE6OF02GLMS2.15.11.A11.1.454.CMB.1.raw
  modified_base (366)..(366): a, c, t, g, unknown or other
  misc_feature (366)..(366): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaaggccctgctactgatgaagcttaacactgatggcagccaagaggtaagggggacggactcccgtgactcgtcttcncgaggctccgagtcctcggtggggctggacgcgtcctacctcacctattcctacccgacgtccctccgagttccgtaggacggtatcggacggtctaggtaaccttaacgttacgtcggtacgacggtaccgtggggcctacggtggactaagttaggttcgggg

SEQ ID NO: 273844 - DNA, 589 bp, Homo sapiens
  misc_feature: GYAE6OF02INH5M.15.11.A11.1.454.CMB.1.raw
  modified_base (324)..(324): a, c, t, g, unknown or other
  misc_feature (324)..(324): n is a, c, g, or t
  modified_base (405)..(405): a, c, t, g, unknown or other
  misc_feature (405)..(405): n is a, c, g, or t
  modified_base (468)..(468): a, c, t, g, unknown or other
  misc_feature (468)..(468): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgccctccgtgggagcctcggtcaagctcacctgcactctgacgcaggtcgggcacaccagcctacgcctatcgcatggcatcagcagcagccagacgaacggcctgctatgatgaaagcttaaacnctgatggcacgcctaagagggtaaaggggggaccggtaatcccgtggaactcgtcttcgacgaggtcctccgtaggttcgnggggctggacgcgccacccgtgtcatcctaccgacgtccctacgacgttccgtaggaagggtntacgggtacggggttactacctttaagtttacgtttcgggtaccaacggggttaccggtggggggtcctaaggggttcgggtcccgtttacggaacggggtccttaacggttcccgggggg

SEQ ID NO: 273845 - DNA, 577 bp, Homo sapiens
  misc_feature: GYAE6OF02GIB7Q.15.11.A11.1.454.CMB.1.raw
  modified_base (373)..(373): a, c, t, g, unknown or other
  misc_feature (373)..(373): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcacctgcactctgagcagtgggcacaccagctacgccatcgcatggcatcagcagcagccagacgaaggccctcgctacttgatgaacgtcttaacactgatggcagccaagaggtaacgggggacggatcccgtgactcgtcttcncgacggctaccgagtccgtccgtggggtctaggacgccgaccttacccgccaaccgacttcctacccacggtccctaccgacgttccgtacgaaggtacgtgggacggtctacggtaaccttaacgtttaccgtacggtactaaccgggtaacccggtgggggtacctacggttcgggaaccgttaaggttgggtttacggggg

SEQ ID NO: 273846 - DNA, 536 bp, Homo sapiens
  misc_feature: GYAE6OF02GA5C0.15.11.A11.1.454.CMB.1.raw
  modified_base (194)..(194): a, c, t, g, unknown or other
  misc_feature (194)..(194): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
  modified_base (464)..(464): a, c, t, g, unknown or other
  misc_feature (464)..(464): n is a, c, g, or t
tcagtctacgtagccacgaccggtgctcgatttagctacgactgcagggtgggtaagaaatacctgcaactgtcagcctcagcagagctctgggggagtctgcaccatggcttggaccccactcctcttcctcaccctcctcctccactgcacagggtctctcgtcccaggcttgtgctgactcaatcgccctntgcctctcgcctcccgtgggacgcctcgggtacaagctcacctgcactctgagcagtggcacacagctacgcatcgcatggcatcagcagcagccagacgaacgggtcccngctactgatggaancttaacgctgatcggacagcctagaggtaacgggggacggactcccgaggactcggtctttcgcgacgggtcctcgagtccgtcgtggggctggacnccgcctaccctcgactactcnccacgtcccttcgagttccaggacgtnttcggacgtctagacttattccgtgtaccgacgttccggacgggtcacggtggtactaggttaggttcgggg

SEQ ID NO: 273847 - DNA, 617 bp, Homo sapiens
  misc_feature: GYAE6OF02HJCU1.15.11.A11.1.454.CMB.1.raw
  modified_base (210)..(210): a, c, t, g, unknown or other
  misc_feature (210)..(210): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctcctgggancctcggtcaagctcacctgcactctgagcagtgggcacaccagctacgccatccgcatggcatcagcagcagccagaggaacgggccctcgctacttgatagaacgtcttaaacacgtagaagtcggcacgacccaagtaggggtaaacgggggacggtactcccgtaggactacggtcctttcgcgaacggtcctccgaggtccgttcggtacggggcttcggacggccgtaccttacctccaacctactccctaccgaccgtacccctccgtacgttccgtaggtaacggtcttagggacgtacgttaaccggtaacctttaagtttaccgtacggttaccggaaccggtacccgggtggggcctaacggttcgggtaacgttaaggtttacggggtttcggggg

SEQ ID NO: 273848 - DNA, 571 bp, Homo sapiens
  misc_feature: GYAE6OF02IXO7R.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctcccgtgggagcctcggtcaagctcacctgcactctgagcagtgggcacaccagctacgccatcgcatggcatcagcagcagccagagaacgggcctcgctactgatgaagctaacactgatggcagccaagaggtaaggggacggactcccgtgactcgcttcgtcgacggctacgagcctcgtcggggctggacgcgaccttaccgtcacctactcctacccacgcccttaccgacgttccgtaggaacggtagtacgggaccgtcgttacgtaaccgtttacgtttaaccgttcggtaccgtaacggtacccggttacgggggtacctaaccggttcgggaaccttaaggttacgggtttcgggggg

SEQ ID NO: 273849 - DNA, 593 bp, Homo sapiens
  misc_feature: GYAE6OF02IRPWR.15.11.A11.1.454.CMB.1.raw
  modified_base (396)..(396): a, c, t, g, unknown or other
  misc_feature (396)..(396): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctcgccctcccgtgggacgcctcggtcaagctcacctgcactctgagcagtggcacaccagctacgccatcgcatggcatcagcagcagccagagacggccctgctactgatgaagtcttaacactgatggcagccaagagggtaacgggggacggactcccgtagactcgctttcgacgaggcctccgagtccgtcggnggggacttggacgcgacctaccgtcaacccgtatcccgtacccgacgtccctaccgtaggttccgtaaggacggtactacgggaacggtccttaacggtaacctttaacgtttaaccgtcggttaaccgaacgggtacccggttacgggggaccctaacggttcgggtaaccgttaaaggtttcggggtttcggggg

SEQ ID NO: 273850 - DNA, 592 bp, Homo sapiens
  misc_feature: GYAE6OF02GILKD.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctcgcctctcgcctcccgtgggacgccctcggtcaacgcctcacctgcactctgagcaggtgggcacacagctacgccatccgcagtggacatcagcagcagccaagacgaacggccctcgctacgtgatagaatcttaacacgtgaacgtcggacaacggacctaacgaaacggggtaacggggggaaccggtactaccccggttagggaaccttccggtcctttacgaccggaacgggtccctaccggtacgtccgtacggtcggggacttaggacgtccgttccctaacctaccgaactctccgccaacggtcctccgagtcagagtatcggatcagtacttaagtcgtcgtacacggtaccggtgggacctacgttaggacttagttcgggttcgggg

SEQ ID NO: 273851 - DNA, 761 bp, Homo sapiens
  misc_feature: GYAE6OF02IP5CO.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatccgccctctcgcctcctcgccctcccgtgggacgtcccgttcggtaccaaacgcctccgacccgttgcctacttcgtggacgcgacggtcgggacaaccgaccgaacgtccgtaccggaccctagtccggacctaacgtcgggactacgtaccgacgaccgaacgccgaacgaccgaacgggtaaccggaaccgggtccccgtcgtacctttaaccgttggtaacgtacggaacgtaacctaaacacgtaggtaagttacggacgaacggaccgtaacggtaaacggggtaaacggggggacggtaccgtcccgtaggtactaccgttacctacgtaccggacggtaccctaccgacgtccgttcgggtcggggtctacgggaccgtccgtaccctacccgtctaccgttacgtacccgacccgtaccgcccgttaaccgttcgtaaccttacgggacgtacggtacgacgttaccggtatttacccgtaaagtttccggtacgtacccgaacggttaccgggtccgggtacgtaaccggttacggtaacgggttaggtttacggggtttaccgggg

SEQ ID NO: 273852 - DNA, 643 bp, Homo sapiens
  misc_feature: GYAE6OF02GB8TF.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggacgccgtcggtcaagctccacctgcactctgagcgaggtcgggcacaccagctacgccatcgcatggcatcagcagcacgccagacggacggccctcgctacgtgaatgaacggtacctaacacgtagagtggacacgacccgaacggaagggtaacggggggaccggtactcccgagtacgtccgtccttacgtaccgtacgggtacctccggacgttccgtacgggtcggggtccgttacgggacgtccccggtaccttaacccgtccctaaacccgtaccttcccgtacccgaccgtcccctaccgtacgttccggtacggaaggtacgtacgggtacggtcttacggtaacttttacgttaaccgtcggtaaccgtaccggtaccggtcgggacctacggtcggtaacgttagggttcgggtttcggggg

SEQ ID NO: 273853 - DNA, 795 bp, Homo sapiens
  misc_feature: GYAE6OF02H8IYZ.15.11.A11.1.454.CMB.1.raw
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcatccgccctctcgcctctcgccctcccgtggggactccctcggttaccaagtcctacaccgtgctacctctggacgcgaggtcgggacacaaccgagccgtaccgacctagtccgactagtcggcacgtacacgacacggcacggaccgaaggaacgggaacccgggtccctcggtaccttacgtaggacgttacggaaacgtacctttaaacgacgtaggtacggtcgggtacaacggacccgtaacggtaaacggggtaaccgggggggtaccggtaccttaccccggtaggtacgttcccgttaccgtttaccgtaccggaccggtcccgtaccgtacggttccggttccggggttggggtaccgttacgggtacccggtacccggtacccgttaacccgtcctaaccccgttaccgttccccgttaacccgttcccggtaccccttaccgtaccggttaccgtacgggaacggtacggttacgggaaccgttcggttacttaacccggttaacgtttaccggttaaccggtaccgtaaccgggtccggtacggggttaaccgtaccggttaacgggtaacgtttacgggttaggggtttttacccggggg

SEQ ID NO: 273854 - DNA, 622 bp, Homo sapiens
  misc_feature: GYAE6OF02HXRCS.15.11.A11.1.454.CMB.1.raw
  modified_base (347)..(347): a, c, t, g, unknown or other
  misc_feature (347)..(347): n is a, c, g, or t
  modified_base (549)..(549): a, c, t, g, unknown or other
  misc_feature (549)..(549): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctcgcctcccgtgggacgcctcggtcaagctcacctgcactctgagcaggtcggcaaccaccagtctaccgccatcgcagtcggcatcgacgcagcacgcgaaggacggaaccgggtccctcgtactacgtgagtagaacgtacttaaacntagagtgacagccaaggacggggtaacggggacggtactccgtagactccgtcttaccgcgacgtcctacctacggccgttacggtgggacttcggacgtccgacccttacgtccaacccgtcttccgacctcgtccctacgtacgttccgacgggtaaggtacgttggggcttaccgttaggtaacttacggtttaaccgnggtaccccgaagggttaccccggtggggaacccttacggtaccgggtaacgttagggttcgggtttacggggg

SEQ ID NO: 273855 - DNA, 642 bp, Homo sapiens
  misc_feature: GYAE6OF02FJPLI.15.11.A11.1.454.CMB.1.raw
  modified_base (540)..(540): a, c, t, g, unknown or other
  misc_feature (540)..(540): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgcctgactcaatcgccctctgcctctgcctcccgtgggacgtcctcggtcaagcctcacctgctactctgacgtcagtgggcacacctagctacgtcatcgcagtgctatcagcagcacgccgagacgacgggccctcggacttacgttgagtacgaacggtaccttaaacacttgagtgggaccacgacccaacggtaagggtaaacggggggccggtaacgttccccgtagtaacgtccgtactttccgtacgacggtcctacgacgtccgtcggtcggggacttcggaccggcgtacccttacccgtaccaccgtacttcccgtaccgaccgtccccgttaccgacgttccgtggaaaccggtnttacgggaacggtcgtaacgtaccgtttaacgttaccgtaccgttaccgacggttacccgggcgggttccaacggtcggacgttaagggtacggtttcgggg

SEQ ID NO: 273856 - DNA, 698 bp, Homo sapiens
  misc_feature: GYAE6OF02I5RHT.15.11.A11.1.454.CMB.1.raw
  modified_base (498)..(498): a, c, t, g, unknown or other
  misc_feature (498)..(498): n is a, c, g, or t
  modified_base (537)..(537): a, c, t, g, unknown or other
  misc_feature (537)..(537): n is a, c, g, or t
  modified_base (547)..(547): a, c, t, g, unknown or other
  misc_feature (547)..(547): n is a, c, g, or t
  modified_base (597)..(597): a, c, t, g, unknown or other
  misc_feature (597)..(597): n is a, c, g, or t
tcagtctacgtagccacgaccggtgctcgatttagctacgactgcagggtgggtaagaaatacctgcaactgtcagcctcagcagagctctggggagtctgcaccatggcttcggaccccactcctcttcctccaccctccctcctccactcgccacgacgggtcctcctcctcccagtccttgtcgctcgactcaactccgccctctcgcctctcgcccgtccgtgggactcccgttcggaccacgtcctacctaccctgtccctaacgtccgtgacgtccgtaggtcggaccaccaccgtacgtaccgaccgacctacgtccgaccgtagttcgggacctaccgtacgacgaccgaacgccgaacggaaccgacgggtaaccggaaccggtcccgttacgtaccgtaccgttagacgtacgtaaaccgtactaaccgtagtgacgtacgacgacggaacgaacggtacggggaaacggggtccgtaccacgtacgngttaccgtctacgcgtacgtcacgtcgtcgtcggcggtnacggcgtccnctaaccgtccgactaccgtcctaccgaccgtacccgtcgtaccgtcgtanacggtacgtcgacgtcgtaaccgttacgtacggtttaccaggttacccggacgtaccgggtaggtaaccgacgttaccggagttttacggtacgggtcggg

SEQ ID NO: 273857 - DNA, 519 bp, Homo sapiens
  misc_feature: GYAE6OF02I66NM.15.11.A11.1.454.CMB.1.raw
  modified_base (212)..(212): a, c, t, g, unknown or other
  misc_feature (212)..(212): n is a, c, g, or t
tcagtctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgtctccctgggacncctcggtcaagctcacctgcactctgacgcagtggcacaccagctacgccatcgcatggcatcagcagcagccagagaaggccctgctacttgatgaagtcttaacacgtgaatggacagccaagtaagggtaacgggggacggactcccgtagactccgctttcgcgaggctcagtctcgtgggctgagcgctacctcaccatcctccgacgtccctaccgagttctggacgctggacggtctgtaacttaattacctgtacgacggtaccgtagggcctacgttgggactaagttcggttacggg

SEQ ID NO: 273858 - DNA, 773 bp, Homo sapiens
  misc_feature: GYAE6OF02HL6RE.15.11.A11.1.454.CMB.1.raw
  modified_base (112)..(112): a, c, t, g, unknown or other
  misc_feature (112)..(112): n is a, c, g, or t
  modified_base (125)..(125): a, c, t, g, unknown or other
  misc_feature (125)..(125): n is a, c, g, or t
  modified_base (138)..(138): a, c, t, g, unknown or other
  misc_feature (138)..(138): n is a, c, g, or t
  modified_base (178)..(178): a, c, t, g, unknown or other
  misc_feature (178)..(178): n is a, c, g, or t
  modified_base (236)..(236): a, c, t, g, unknown or other
  misc_feature (236)..(236): n is a, c, g, or t
tcagtctacgtagccacgaccggtgctcgatttagctacgactgcgaggggtgggtaaagaaatacctgcaactgtcagcctcagcagagctcgtggggagtctgcacctanggtctcggacccnctcctcttctccnccctcctcctcctactgcaacgtacggtcctcctcctccngtcctggttcgcgtatactacaactccggtcctctcgtccctctccgtaccttccggngggacgtccgtcggacacgctccgactcacttccgtagtacgacgtggtaccggcggaaccaaccaaccgacgtaccgaccaccactcgacgaggttacacctagacgagacgacgtacgagaaccggtaaggacccgggtacggtccccggactaccgttataggacgttaacgaaccgtttaacctaatacggttacgcggaacgtacccaaggtaccgggtaaacgggtaaagggggaacgggcgttacccgtacgtccgggtactttacccgcggttaccgttacccgagacccggttgtacccgggtacgtaccgggtaggttcccggaaggtacccggtaaccggttaaccccttaccgaccgtacccgttaccgcccggaaacttcccgaccgttaactcgtagggtagacggtacgaggtaccgggtacttacggtacgttaaccgttacggaccgttaaccgggtaaccggtcggttaacgcgggtaacgggttccggtaaaggtttccggtagggttttacccgggg

SEQ ID NO: 273859 - DNA, 821 bp, Homo sapiens
  misc_feature: GYAE6OF02IQPY7.15.11.A11.1.454.CMB.1.raw
  modified_base (179)..(179): a, c, t, g, unknown or other
  misc_feature (179)..(179): n is a, c, g, or t
tcagtctacgtagccacgaccggtgctcgatttagctacgactgcagggtgggtaagaaatacctgcaactgtcagcctcagcagagctctggggatctgcaccatggcttggaccccatcctcttcctcaccctcctcctccactgcacgtagggtcctcgtcctcccagtctttagngcctagacctacgaactccgcccttgtcgcccttcgtcgccccttccggtagggaccgtcccgttacggtacaacggtcctaccaccgtcggacctacgtcgtacggcgacgacggtcggaccaccgtaccgcggacctaccgtaccacgttccgactacgtacgggtactaccgtacgaacggtcgacgccggtaacggaccgaacgggtacggtaacccggccccgtttacgtaccgttacggtcgtaaacgtacggtaaaccgttaacttaacgacgttcgggaacgttccggaccgtaaccggtaacccgtaagggggttaaacgggggtaacccgggggtacgtacccgtttaccgtacgggtaacttcccggttaaccttaccggaaccggtccggtaccgttaaccggacggttccggtaacgggtggacccgttagggacccgttaccgtcccgttaaccgtacctaacccgttcgtacccctaccggtaacccggttcgttaacgaaccgttcggaaagggtcgttacgacggtaccgtacgttacggttacgttcttaaccgggactaccggtacggtaccggtacggtacttcgggtaaccggtaacggtttaggtacccggggtttcggg

SEQ ID NO: 273860 - DNA, 246 bp, Homo sapiens
  misc_feature: GYAE6OF01A2OBB.48.34.D01.1.454.CMB.1.raw
  modified_base (245)..(246): a, c, t, g, unknown or other
  misc_feature (245)..(246): n is a, c, g, or t
tcagagtatacatacacgaccggtgctcgatttagatcgtctgtgttgggtttggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnn

SEQ ID NO: 273861 - DNA, 247 bp, Homo sapiens
  misc_feature: GYAE6OF01C7XOK.48.34.D01.1.454.CMB.1.raw
  modified_base (246)..(247): a, c, t, g, unknown or other
  misc_feature (246)..(247): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnn

SEQ ID NO: 273862 - DNA, 246 bp, Homo sapiens
  misc_feature: GYAE6OF01BAVIP.48.34.D01.1.454.CMB.1.raw
  modified_base (246)..(246): a, c, t, g, unknown or other
  misc_feature (246)..(246): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagn

SEQ ID NO: 273863 - DNA, 249 bp, Homo sapiens
  misc_feature: GYAE6OF01AKSN6.48.34.D01.1.454.CMB.1.raw
  modified_base (246)..(249): a, c, t, g, unknown or other
  misc_feature (246)..(249): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnnn

SEQ ID NO: 273864 - DNA, 246 bp, Homo sapiens; identical to SEQ ID NO: 273862
  misc_feature: GYAE6OF01EXU1M.48.34.D01.1.454.CMB.1.raw
  modified_base (246)..(246): a, c, t, g, unknown or other
  misc_feature (246)..(246): n is a, c, g, or t

SEQ ID NO: 273865 - DNA, 247 bp, Homo sapiens
  misc_feature: GYAE6OF01AU7PP.48.34.D01.1.454.CMB.1.raw
  modified_base (246)..(247): a, c, t, g, unknown or other
  misc_feature (246)..(247): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnn

SEQ ID NO: 273866 - DNA, 246 bp, Homo sapiens; identical to SEQ ID NO: 273862
  misc_feature: GYAE6OF01ETLI0.48.34.D01.1.454.CMB.1.raw
  modified_base (246)..(246): a, c, t, g, unknown or other
  misc_feature (246)..(246): n is a, c, g, or t

SEQ ID NO: 273867 - DNA, 808 bp, Homo sapiens
  misc_feature: GYAE6OF01BFM60.48.34.D01.1.454.CMB.1.raw
tcagagtatacatacacgaccggtgctcgatttagatcgtctgtgttgggtgcagttggtggagtcgggggaggtgtggtccagcctgggaagtccctgacactgtcctgcgcaacgcctgtgtactcctaccttcacccttacctttcgtatcgaccttacgtttcgtcccgaccgaggtccctaccggacggacgggaacggggtcgtagggtagggttggggtcggtcgtttggtttggtcgtaactaaagtgagtacggaactagtcgtcgtaagtaaattagtcgacgaacgtacccgttccgggtaggggaccggggtaccttacgttcccgtccctttccaccgaaggaacgaacttaacttaccgaaaggcgtaccgttacggttacacttcgtacgaaactaaagtcggaccgcccgtccgtaggaaccgtaccgtaggaaccgaccgacggtcttacgttacttaacgtttcgtggtacggaacggaggggtacggtccgtaacggttaaacgttaaccgccgggtccgggtaggggaagtacttacgtttacgttacgaaccgtaacgggtcgggaccgtaaccgggtaccgttcggtacccgtaccgttcctccacgaccgtcccctaacccgaacggaccggtccctacgttcccggttcccctcccggcggcccctcccgtcgcccgtacggacggccacccgtacccgtcggacgacgacccgacggaccggcccggttccggtgggtcctcccggtcggttacggaaacgtacggttacccttcccgttacg

SEQ ID NO: 273868 - DNA, 246 bp, Homo sapiens
  misc_feature: GYAE6OF01EADUC.48.34.D01.1.454.CMB.1.raw
  modified_base (246)..(246): a, c, t, g, unknown or other
  misc_feature (246)..(246): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagn

SEQ ID NO: 273869 - DNA, 283 bp, Homo sapiens
  misc_feature: GYAE6OF01EU1B5.48.34.D01.1.454.CMB.1.raw
  modified_base (252)..(283): a, c, t, g, unknown or other
  misc_feature (252)..(283): n is a, c, g, or t
tcagagtatacatacacgaccggtgctcgatttagatcgtctgtggttgggtttggagggtgtggtggtctcccactcccgccttgacgaggcctgattactactgtcagtcttttgataacaacaatcacgtggtcttcggcggagggaccagcctgaccgtcctaggtcagcccaaggctgccccctcggtcactctgttcccaccctccgtctatgtactactctgagcgggctggcaaggcgcatagnnnnnnnnnnnnnnnnnnnnnnnnnnnnnnnn

SEQ ID NO: 273870 - DNA, 528 bp, Homo sapiens
  misc_feature: GYAE6OF01EBP9G.48.34.D01.1.454.CMB.1.raw
  modified_base (501)..(501): a, c, t, g, unknown or other
  misc_feature (501)..(501): n is a, c, g, or t
tcagagtatacatacacgaccggtgctcgatttagatcgtctgtgttggggttggggctgtgggctcaggaggcagagctctgggaatctcaccatggcctggacccctctcctgctccccctcctcactttctgcacagtctctgaggcctcctctgagctgacacagccaccctcggtgtcagtgtcccaggacaaacggccaggatcacctgctctggagatgcattgccaagaaaattttgttattggtaccaactgaagtcaggccaggcccctgtcctggtcatttatgaggacgaccagcgaccctcaggatcccctgcgaggttctctggatcgaactcgagggacattcggccaccttgactatcacgtggggcccgaggtggaggagtgaaggtgactacttctgtttctcaacagacaccagtgacaatcatgcgtagttttcggcggagggacaagctcgaccgtccgtcggtcacggcccgaacggcncgcccctcggtccactcgtcgtccccg

SEQ ID NO: 273871 - DNA, 244 bp, Homo sapiens
  misc_feature: GYAE6OF01BEPEW.48.34.D01.1.454.CMB.1.raw
tcagagtatacatacacgaccggtgctcgatttagatcgtctgtgttgggtttgggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccaccctcctctatgtatactctgagcgggctggcaaggcgcatag

SEQ ID NO: 273872 - DNA, 245 bp, Homo sapiens
  misc_feature: GYAE6OF01CDQ6M.48.34.D01.1.454.CMB.1.raw
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatag

SEQ ID NO: 273873 - DNA, 247 bp, Homo sapiens; identical to SEQ ID NO: 273861
  misc_feature: GYAE6OF01E5DGT.48.34.D01.1.454.CMB.1.raw
  modified_base (246)..(247): a, c, t, g, unknown or other
  misc_feature (246)..(247): n is a, c, g, or t

SEQ ID NO: 273874 - DNA, 248 bp, Homo sapiens
  misc_feature: GYAE6OF01EMG8R.48.34.D01.1.454.CMB.1.raw
  modified_base (246)..(248): a, c, t, g, unknown or other
  misc_feature (246)..(248): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnn

SEQ ID NO: 273875 - DNA, 311 bp, Homo sapiens
  misc_feature: GYAE6OF01CSVVW.48.34.D01.1.454.CMB.1.raw
  modified_base (255)..(263): a, c, t, g, unknown or other
  misc_feature (255)..(263): n is a, c, g, or t
  modified_base (265)..(311): a, c, t, g, unknown or other
  misc_feature (265)..(311): n is a, c, g, or t
tcagagtatacatacacgaccggtgctcgatttagatcgtctgtggttgggttgggggtgtggtggtctccacctcccgccttgacgaggctcgattactactgtcagtcttttgataacaacaatcacgtgttccttcggcggagggaccaggcctagaccgtcctaggtcagcccaaggctgccccctcggtcactctgttcccaccctcctcgtatgtatacctctgagcgggctggcaaggcgcagtacgnnnnnnnnngnnnnnnnnnnnnnnnnnnnnnnnnnnnnnnnnnnnnnnnnnnnnnnn

SEQ ID NO: 273876 - DNA, 246 bp, Homo sapiens
  misc_feature: GYAE6OF01DZLMS.48.34.D01.1.454.CMB.1.raw
  modified_base (245)..(246): a, c, t, g, unknown or other
  misc_feature (245)..(246): n is a, c, g, or t
tcagagtatacatacacgaccggtgctcgatttagatcgtctgtgttgggtttgggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccaccctcctctatgtatactctgagcgggctggcaaggcgcatagnn

SEQ ID NO: 273877 - DNA, 248 bp, Homo sapiens
  misc_feature: GYAE6OF01CVBNY.48.34.D01.1.454.CMB.1.raw
  modified_base (247)..(248): a, c, t, g, unknown or other
  misc_feature (247)..(248): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttccccgccctcctctatgtatactctgagcgggctggcaaggcgcatagnn

SEQ ID NO: 273878 - DNA, 247 bp, Homo sapiens; identical to SEQ ID NO: 273865
  misc_feature: GYAE6OF01CPSUW.48.34.D01.1.454.CMB.1.raw
  modified_base (246)..(247): a, c, t, g, unknown or other
  misc_feature (246)..(247): n is a, c, g, or t

SEQ ID NO: 273879 - DNA, 247 bp, Homo sapiens; identical to SEQ ID NO: 273861
  misc_feature: GYAE6OF01CYQTK.48.34.D01.1.454.CMB.1.raw
  modified_base (246)..(247): a, c, t, g, unknown or other
  misc_feature (246)..(247): n is a, c, g, or t

SEQ ID NO: 273880 - DNA, 246 bp, Homo sapiens; identical to SEQ ID NO: 273862
  misc_feature: GYAE6OF01ENNC0.48.34.D01.1.454.CMB.1.raw
  modified_base (246)..(246): a, c, t, g, unknown or other
  misc_feature (246)..(246): n is a, c, g, or t

SEQ ID NO: 273881 - DNA, 270 bp, Homo sapiens
  misc_feature: GYAE6OF01BI3R0.48.34.D01.1.454.CMB.1.raw
  modified_base (240)..(270): a, c, t, g, unknown or other
  misc_feature (240)..(270): n is a, c, g, or t
tcagagtatacatacacgaccggtgctcgatttagatcgtctgtgttgggtttgggggtgtggtggtctccactccgccttgacgagctgattacctactgtcagtcttttgataacacatcacgtgtctcgcgaggaccagcctgaccgtctaggtcagcccaaggctgccccctcggtcactctgttcccaccctctctatcgtagtactctgacgccgggctggcaaggcgcatagnnnnnnnnnnnnnnnnnnnnnnnnnnnnnnn

SEQ ID NO: 273882 - DNA, 247 bp, Homo sapiens
  misc_feature: GYAE6OF01B0BD8.48.34.D01.1.454.CMB.1.raw
  modified_base (247)..(247): a, c, t, g, unknown or other
  misc_feature (247)..(247): n is a, c, g, or t
tcagagtatacatacacgaccggtgctcgatttagatcgtctgtgttgggtttgggggtggtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagn

SEQ ID NO: 273883 - DNA, 248 bp, Homo sapiens; identical to SEQ ID NO: 273874
  misc_feature: GYAE6OF01D2K1O.48.34.D01.1.454.CMB.1.raw
  modified_base (246)..(248): a, c, t, g, unknown or other
  misc_feature (246)..(248): n is a, c, g, or t

SEQ ID NO: 273884 - DNA, 248 bp, Homo sapiens
  misc_feature: GYAE6OF01DKFOZ.48.34.D01.1.454.CMB.1.raw
  modified_base (247)..(248): a, c, t, g, unknown or other
  misc_feature (247)..(248): n is a, c, g, or t
tcagagtatacatacacgaccggtgctcgatttagatcgtctgtgttgggtttggagggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnn

SEQ ID NO: 273885 - DNA, 552 bp, Homo sapiens
  misc_feature: GYAE6OF01D0N5J.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacggccgtcgggaggatattactttgaacaacgtgggaccagggaaccctggtcaccgtctcctcacgcctccaccaagggcccagtccgtcctccccgtggccgccctgcctccgaggacgccaccctccgacgagccacaggcccggcccgtcgggctcggtcccgtggtaccgaacgggtacctacgtttacccg

SEQ ID NO: 273886 - DNA, 597 bp, Homo sapiens
  misc_feature: GYAE6OF01D7MTP.48.34.D01.1.454.CMB.1.raw
  modified_base (333)..(333): a, c, t, g, unknown or other
  misc_feature (333)..(333): n is a, c, g, or t
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgctactttgtccgccaggctccaggcaaggggctggagtgggtggctgttgtgtcaaatgatggacatgctgaatatgcagactccgtgaggggccattcgccttctccagagacaattccaagagcaacggttcatctgacaaatgagccgccctgacgacctgacgacacggtctgtctattacngtgcgagaggctcgagttaacgaagccgtagggaggtattattacgtttgaacgtaacgtggggaccagggtaaccctggtaccaccgtctcctcacgtccctccgaaccaacgggcccaagttcccgtaccttcccccgtacgcccgtccctacgcctccgacggacgaccgacccgtccgagacgaccgaccgaggtcccggccccggttggcccgttcggacccgttcgggtaacctaacgggtaccttaccgtttacccg

SEQ ID NO: 273887 - DNA, 285 bp, Homo sapiens
  misc_feature: GYAE6OF01BHDAL.48.34.D01.1.454.CMB.1.raw
  modified_base (246)..(285): a, c, t, g, unknown or other
  misc_feature (246)..(285): n is a, c, g, or t
tcagagtatacatacacgaccggtgctcgatttagatcgtctgtgttgggttgggggtgtggtggtctccactcccgccttgacgaggctgattactactgtcagtcttttgataacaacaatcgacgtggtcttcggcggagggaccagcctgaccgtcctaggtcagcccaaggctgccccctcggtcactctgttcccgccctcctctatgtatactctgagcgggctggcaaggcgcatagnnnnnnnnnnnnnnnnnnnnnnnnnnnnnnnnnnnnnnnn

SEQ ID NO: 273888 - DNA, 529 bp, Homo sapiens
  misc_feature: GYAE6OF01B40Z0.48.34.D01.1.454.CMB.1.raw
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaagagcacggttcatctgcaaatgagcgccctgagacctgacgacacggctgtctattactgtgcgagagggcgtccgagtttaacacgccgtcgggaggatattactttgacaactgggccagggaaccctggtcaccgtctcctcacgcctccaccaaggcccatccgtctcccctggccgccctgcctccacggacgcacctccgacgacgcacagccggccctcgggcctcggccctggtccaaggcctacgttacccg

SEQ ID NO: 273889 - DNA, 293 bp, Homo sapiens
  misc_feature: GYAE6OF01DMN7M.48.34.D01.1.454.CMB.1.raw
  modified_base (254)..(255): a, c, t, g, unknown or other
  misc_feature (254)..(255): n is a, c, g, or t
  modified_base (257)..(293): a, c, t, g, unknown or other
  misc_feature (257)..(293): n is a, c, g, or t
tcagagtatacatacacgaccggtgctcgatttagatcgtctgtgttgggtttgggagggtgtggtggtctccactcccgccttgacgaggctgattactactgtcagtcttttgactaacaacaatcacgtggtcttcggcggagggaccagcctgaccgtcctaggtcagcccaaaggctgccccctcggtcactctgttccccgccctctctatgtatacgtctgacgcgggctggcaaggcgctagtagnnannnnnnnnnnnnnnnnnnnnnnnnnnnnnnnnnnnnn

SEQ ID NO: 273890 - DNA, 246 bp, Homo sapiens; identical to SEQ ID NO: 273862
  misc_feature: GYAE6OF01AJDR3.48.34.D01.1.454.CMB.1.raw
  modified_base (246)..(246): a, c, t, g, unknown or other
  misc_feature (246)..(246): n is a, c, g, or t

SEQ ID NO: 273891 - DNA, 567 bp, Homo sapiens
  misc_feature: GYAE6OF01CP9V0.48.34.D01.1.454.CMB.1.raw
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (413)..(413): a, c, t, g, unknown or other
  misc_feature (413)..(413): n is a, c, g, or t
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgcttctccagagacaattccaagagcacggttcatctgacaaatgagccgccctgacgacctgatgacacggctgtctattactgtgcgagnggctcgagttaacncgcgtcggaggatattacttgactacgtcgggacagggaccctggtcctaccgtctcctacncgccctacccaccgaacgggccctacgttccggtcccttacccccgtggacccgtcccctcgccttccgacggacgcccacccgtccgagacgccaccgacggcccgggccccgtggggcctccggcccgtaggtaccaacgggtccttacccg

SEQ ID NO: 273892 - DNA, 246 bp, Homo sapiens; identical to SEQ ID NO: 273868
  misc_feature: GYAE6OF01D7BPD.48.34.D01.1.454.CMB.1.raw
  modified_base (246)..(246): a, c, t, g, unknown or other
  misc_feature (246)..(246): n is a, c, g, or t

SEQ ID NO: 273893 - DNA, 248 bp, Homo sapiens
  misc_feature: GYAE6OF01B409P.48.34.D01.1.454.CMB.1.raw
  modified_base (245)..(248): a, c, t, g, unknown or other
  misc_feature (245)..(248): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcatagnnnn

SEQ ID NO: 273894 - DNA, 407 bp, Homo sapiens
  misc_feature: GYAE6OF01C3REY.48.34.D01.1.454.CMB.1.raw
  modified_base (400)..(407): a, c, t, g, unknown or other
  misc_feature (400)..(407): n is a, c, g, or t
tcagagtatacatacacgaccggtgctcgatttagatcgtctgtgttgggtttggggatactacgttgcaggtgtaggtctgggtgccgattcgccttctccagagacaattccaagagcacggttcatctgcaaatgagcgccctgagacctgacgacacggctgtctattactgtgcgagagggcgtccgagtttaacacgccggtcgggagggatattacttgacaactggggccaggggaaccctggtcaccgtctcctcagcctccaccaagggcccatcggtcttcccctggcgccctgctccaggagcacctccgagagcacagcggccctgggctgcctggtcaaggctacttcctctctcgactctgagcgggctggcaaggcgtcatagnnnnnnnn

SEQ ID NO: 273895 - DNA, 554 bp, Homo sapiens
  misc_feature: GYAE6OF01BI6M1.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaagagcacggttcatctgcaaatgagcgccctgagacctgacgacacggctgtctattactgtgcgagaggcgtccgagtttaacacgccgtcgggaggatattactttgacaacgtgggccagggaccctggtcaccgtctcctcacgcctccaccaacgggcccagtccgtccttcccccgtaggcccgccctcgcctccgacggacgccaccgtccgacgacgcgaccgacgccggccctcgggcctcggcccgtggtaccaacgggtaccttaccgttccccg

SEQ ID NO: 273896 - DNA, 571 bp, Homo sapiens
  misc_feature: GYAE6OF01A8E1N.48.34.D01.1.454.CMB.1.raw
  modified_base (344)..(344): a, c, t, g, unknown or other
  misc_feature (344)..(344): n is a, c, g, or t
tcagagtatacatacacgaccggtgctcgatttagatcgtctgtgttggggtgcagttcggtggagtcggggggaggtgtggtccagcctgggaagtccctggaccactgtcctgcgcgagcctctggattcaccttcaccacctttcgtatgacactttgtccgccaggctccaggccaaggggctggagtcgggtggctgttgtgtcaaatgatggacatgctgaatatgcagacctaccgtgaggggccattcgccttctccagagacaattcccaaggagccacggttcatctgcaaatgagcgcccttgagacctggaccgacacggctgtctattacngtgcgagagggctccgagtttaacacgccgtcgggaggatagttacttgactaacgtgggccagggaccctggtcaccgttctcctcagtcctccaccaaggcccatccgtcttccccgtggccgtcccgtcgaccgtccgagggacgaccacccgtaccgagacgccgacgaggccggcccgtgggcctcggtcccttggtaccaacggtccctaccgtttacccg

SEQ ID NO: 273897 - DNA, 566 bp, Homo sapiens
  misc_feature: GYAE6OF01E2BFL.48.34.D01.1.454.CMB.1.raw
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctganacctgacgacacggctgtctattactgtgcgagacgggcgtccgagtttaacncgccggtcgggaggatattacttgacaacgtgggccagggaccctggtcaccgtctcctcacgcctccaccgaacgggcccagtccggtccttcccccgtcggcccgtccctcgtccctccacggacgccaccgtccgacgacgccgaccgacggccggcccgtcggggcctcggccttacgggtaccgaacggtccttaccgttacccg

SEQ ID NO: 273898 - DNA, 673 bp, Homo sapiens
  misc_feature: GYAE6OF01EP1K6.48.34.D01.1.454.CMB.1.raw
  modified_base (346)..(346): a, c, t, g, unknown or other
  misc_feature (346)..(346): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtgctgttgtgtacaatgatggacatgctgaatatgcagacctccggtggacggggcctattccgccttctccagagacaattccaagagcacggttcatctgacaaatgagccgccctgacgacctgacgacacggcttgtctattactgtgcgaggnggcgtacgtagtttaacgacgtccggtgggaggtattatttacgtttagacgaacgtcggggaccgaacgggtaacccgtggtacctacccggttccttcccgtaccgacgtcccctacccgaacccgtaaccggggccccaacgttcccgggttcccttccccccggtacggtccccgcccccgttcgtccccgttacccgacgggtacgcccgacccgttccggaagaccggaccaaccggacgggaccccgggtccccgtggggtacccttccgggtccccgttagggtacccgaaacgggttacccttccccgttttaccccg

SEQ ID NO: 273899 - DNA, 619 bp, Homo sapiens
  misc_feature: GYAE6OF01AQM3K.48.34.D01.1.454.CMB.1.raw
tcagagtatacatacacgaccggtgctcgatttagatcgtctgtgttggggttgggggctgtgggctcaggaggcagagctctgggaatctcaccatggcctggacccctctcctgctccccctcctcactttctgcacagtctctgaggcctcctctgagctgacacagccaccctcggtgtcagtcgtccccaggacaaacggccaggatcacctgctctggagatgcattgaccaagtaaattttgtattggtaccaatgaagtcaggccacggcccctgtcctggtctatttagtggacggaccgaccagccgaccctccaggactcccgtgcgtaggttctcgtggactccgaatcgagggactagttcgcctacttgactatcgacgtcgggccagggtggagtagtggaaggtcgtacttacttcgttcgtttactacgaacacgtaaccacgtagtacgaactaatacagttcgtacgttaggtttcgggacggaacgggacctaaggtccgtacggtacccggttccgtacgggtccaccgggtacccgaacggtcccgtacccggtccccccgttcggtaccctacccgttccgtcccgttaccccccg

SEQ ID NO: 273900 - DNA, 247 bp, Homo sapiens; identical to SEQ ID NO: 273861
  misc_feature: GYAE6OF01BLTY0.48.34.D01.1.454.CMB.1.raw
  modified_base (246)..(247): a, c, t, g, unknown or other
  misc_feature (246)..(247): n is a, c, g, or t

SEQ ID NO: 273901 - DNA, 254 bp, Homo sapiens
  misc_feature: GYAE6OF01EL5S7.48.34.D01.1.454.CMB.1.raw
  modified_base (253)..(254): a, c, t, g, unknown or other
  misc_feature (253)..(254): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccacctcccaccctcctctatgtatactctgagcgggctggcaaggcgcatagnn

SEQ ID NO: 273902 - DNA, 608 bp, Homo sapiens
  misc_feature: GYAE6OF01D2V41.48.34.D01.1.454.CMB.1.raw
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
tcagagtatacatacacgaccggtgctcgatttagatcgtctgtgttgggtttgggggtgggctcaggaggcagagctctgggaatctcaccatggcctggacccctctcctgcctcccctcctcactttctgcacagtctctgaggcctcctctgagctgacacagcccaccctcggtgtcagtcgtccccgaggacaaacggccaggatcacctgctcgtgganatgcattgacaagtaaattttgtatggtaacaacgtgaagtcaggccacggccctgtcctggtctagtttacngacggaccgaccagcccgtaccctacgaggtactcccgtggccgtagttcncgtagactacgactcgaggtactgtcggccacgttgactatcgtacgtgggccagggtggaggagagtaaggtgtacttacgttcgttgtttacactaaccgagtacaccagtacgaacaatcactagcgtacgtttcggacggtacggacgtaacgcgtacggtaccgtccgtacgggtacaccggaccgaacggtcccgtaccgtcccccgtaccgggtaccctacgttacccttccgttccccgtcccttacccg

SEQ ID NO: 273903 - DNA, 542 bp, Homo sapiens
  misc_feature: GYAE6OF01C5N6T.48.34.D01.1.454.CMB.1.raw
  modified_base (218)..(218): a, c, t, g, unknown or other
  misc_feature (218)..(218): n is a, c, g, or t
  modified_base (381)..(381): a, c, t, g, unknown or other
  misc_feature (381)..(381): n is a, c, g, or t
  modified_base (470)..(470): a, c, t, g, unknown or other
  misc_feature (470)..(470): n is a, c, g, or t
  modified_base (525)..(525): a, c, t, g, unknown or other
  misc_feature (525)..(525): n is a, c, g, or t
  modified_base (535)..(535): a, c, t, g, unknown or other
  misc_feature (535)..(535): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttggggttggggctgtgggctcaggaggcagagctctgggaatctcaccatggcctggacccctctcctgcctccccctctcactttcngcacagtctctgaggcctcctctgagctgacacagcccaccctcggtgtcagtcgtccccaggacaaacggccaggatcacctgctctggagatgcattgaccaagtaaatttgtatggaccaactgaatcaggccaggcccctgtcctggtactagtttacnggaggacgaccagccgaaccctcgacggactccctgccgtaggttctcgtggactcgaactcgacgggactagttcgcctacttgactntcacgtggggacccagggtcgaggtataggaaggtgaacttcgttcttgtttacncaacagaccncagtacg

SEQ ID NO: 273904 - DNA, 608 bp, Homo sapiens
  misc_feature: GYAE6OF01E0N4U.48.34.D01.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
tcagagtatacatacacgaccggtgctcgatttagatcgtctgtggttgggtgcagttggtggaggtccggggggaggtgtggtccagcctcgggaagtccctgacactgtcctgcgcagccctctggattcaccttcaccacctttcgtatgcactttgtccgccaggctccaggcaaggggctggagtgggtggctggttgngtcaaactgatggacatgctgaatatgcagactccgtgaggggccgattcgccttcnccagagacaattccaagagcacggtcatctgcaaatgagcgccctgagacctgacgacacggctgtctattacngtgcgagaggcgtcgagtttaacncgaccgtgggaggaatagttactttggacaacgtcgggccagggaaccctggtacaacggtctcctctacgtcccttccgaccgaacggccccacttccgggttaccttcccccgtagggtcccgccccggttgcccgtaccgaacggaccgtaccgaccgtccgaccggaacgtaccgaaccgtaggacccggcccgttcggggaccctcggtcccgtcggtaccaacggtaccttaccgtttccccg

SEQ ID NO: 273905 - DNA, 559 bp, Homo sapiens
  misc_feature: GYAE6OF01CRAV8.48.34.D01.1.454.CMB.1.raw
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (478)..(478): a, c, t, g, unknown or other
  misc_feature (478)..(478): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgacgcgcccctgacgacctgacgacacggctgtctattactgtgcgagngggctcgagtttaacncgccgtgggaggattattactttgacaacgtgggccagggaccctggtcaccgtctcctcacgccctccaccgacgggcccagtccggtccttcccccgtggccgccctgcctcccgaggcnccaccctccgagacgaccgaccacggccggccccgtgggcccttcggcccgttacggtaccaacggtaccttctttacccg

SEQ ID NO: 273906 - DNA, 295 bp, Homo sapiens
  misc_feature: GYAE6OF01DH698.48.34.D01.1.454.CMB.1.raw
  modified_base (258)..(295): a, c, t, g, unknown or other
  misc_feature (258)..(295): n is a, c, g, or t
tcagagtatacatacacgaccggtgctcgatttagatcgtctgtgttggggtttgggggtgtggtggtctccactcccgccttgacgaggctgattactactgtcagtcttttgataacaacaatccacgtggtcttcggcggaggaccagcctgaccgtcctaggtcagcccaaggctgcccccctggtcactctgttccccgccctcctacgtaatgttaatactctggagccgggctgggacaagggcgcatagnnnnnnnnnnnnnnnnnnnnnnnnnnnnnnnnnnnnnn

SEQ ID NO: 273907 - DNA, 244 bp, Homo sapiens
  misc_feature: GYAE6OF01A2VE9.48.34.D01.1.454.CMB.1.raw
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcatag

SEQ ID NO: 273908 - DNA, 656 bp, Homo sapiens
  misc_feature: GYAE6OF01BWNNU.48.34.D01.1.454.CMB.1.raw
  modified_base (311)..(311): a, c, t, g, unknown or other
  misc_feature (311)..(311): n is a, c, g, or t
tcagagtatacatacacgaccggtgctcgatttagatcgtctgtgttggggttgggggctgtcgggctcaggaggtcagagctctagggaaagtctcaccatggcctggtaccccctcctccctgctccccctcctcactttctgcgacaggtctacgtgaggcctcctctgagctgacacagccaccctcggtgtcagtgtccccaggacaaacggccaggatcacctgctctggagatgcattgaccaagtaaaattttgttattggtaccaactgaagtcaggccaggcccctgtcctggtcatttangaggacgacagcgaccctcaggactccctgcgtaggttctcgtggatacgaactcgagggacagttcggcctacttgactatccacgtggggcccaggtggaggatggaaggtgacttacttcgttagtttctacaacacgaccaacctagtacgaactaactactaagtcgtacggttacgtttttacgggacgggtaacgggtaaccgtaaacggtccgttacgggtaaccccgttccggttcggggttacccgaaccggtcccccgtaaacgggtcccgttacccggtcccccccgttcgggttacccgtaacccttcccggttcccggtttccccccccgg

SEQ ID NO: 273909 - DNA, 700 bp, Homo sapiens
  misc_feature: GYAE6OF01BZU6Z.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccgaggcctccgaggcgaaggggctggaggtggggtggcttggtttgtgtacaaaagtgagtggacatgctagaatatgcagacctccggtggacggggcctattccgtccttcctccgagacgaactaacttaccgaagacgacgtacggttcaacttcgtagaactaaagtggacgcccgcccgtagaacgtaccgtaggaaccgaaccgaccggtcttacgttaccttaacgttacgtggtcggacggaagggacgggtccgtaccgtaacgtttaaccgaccggtccgggtacggggaggtaatttaacgtttacgttacgaaccgtaacgggtcgggaccgtaacgggtaacccgtggtacccaccgttcctacccgtacaccgtccctacccgaaccggaaccgggcccctacgttcccggttccccttcccccgtcgggcccgtcccgtcgccgtaccgacggaccgcccacccgtcgacgacgccacgaccgccggcccgtggcctcgtccgtagacgaacgtcttccttacg

SEQ ID NO: 273910 - DNA, 249 bp, Homo sapiens
  misc_feature: GYAE6OF01EL3T0.48.34.D01.1.454.CMB.1.raw
  modified_base (247)..(249): a, c, t, g, unknown or other
  misc_feature (247)..(249): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcataaagnnn

SEQ ID NO: 273911 - DNA, 246 bp, Homo sapiens; identical to SEQ ID NO: 273868
  misc_feature: GYAE6OF01BUCWE.48.34.D01.1.454.CMB.1.raw
  modified_base (246)..(246): a, c, t, g, unknown or other
  misc_feature (246)..(246): n is a, c, g, or t

SEQ ID NO: 273912 - DNA, 651 bp, Homo sapiens
  misc_feature: GYAE6OF01BNCIU.48.34.D01.1.454.CMB.1.raw
  modified_base (308)..(308): a, c, t, g, unknown or other
  misc_feature (308)..(308): n is a, c, g, or t
  modified_base (463)..(463): a, c, t, g, unknown or other
  misc_feature (463)..(463): n is a, c, g, or t
tcagagtatacatacacgaccggtgctcgatttagatcgtctgtgttggggttgggggctgtgggctcaggaggcagagctctgggaatctcaccatggcctggacccctctcctgcctccccctcctcactttctgcacagtctctgaggcctcctctgagctgacacagccaccctggtgtcagtcgtccccaggacaaacggccaggatcacctgctctggagatgcattgacctaaagtaaaatttttgttattcggtaaccaactgaagtcaggccacggtcccctgtcctggtctagtttanggaggaccgaccagccgaccctcgaggacctcccgtggaccgtaggttcctcgtggactcgaactcgagggactagttcggaccctacgttgactatccgacggtcggggcccgagggtacggaggtagtaggtaaggtcgtacttacttcgttntttacctacaacacgaccacgagtacgaactaatacagtcgtacgttacgtttcgggacgggtacggaccgtaacggtccgtaccgtacccggttccggtcgggtaccgaaccggtaccccgaacggtcccgtccccggtcccccgttaccggttaccccgtaccgttcccgttcccggttccccccg

SEQ ID NO: 273913 - DNA, 669 bp, Homo sapiens
  misc_feature: GYAE6OF01DT4X9.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaaatgatggacatgctgaatatgcagactccggtgaggggccattcgccttctccagagacaattccaagagcacggttcatctgacaaatgacgccgccctgacgacctgacgacacggctgtactattactgtgacggaggacgggtcgtacgaacggtttaaccgaccggtccgggtacggggtagggtattaacgtttacgtttacggaacgtaacggtcggggacccgaacggggtaacccgttcgggtaccctacccggttcctcccgtacgaccgtccctacccgaccggaacgggcccctaacgttcccggtccctttacccccgcgggccccgtccccgtcgtcccgtacccgaacggaccgacccgtacccgtcccgaacggtacgccgaaccgcggcccggtcccgcgggtcctccggtccgtacgggtacgaaccggtacgttaccgtttacccg

SEQ ID NO: 273914 - DNA, 696 bp, Homo sapiens
  misc_feature: GYAE6OF01BOVBD.48.34.D01.1.454.CMB.1.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtggttgggtttggggctgtgggctcaggagcagagctcgtgggaatctcaccatcggcctcggacccctctcctcgcctcccctctcactttcncgcacacgtctcgtgacgcctcctcgtgacnctcgaacacacgccctaccgtcggtctcgagtccgtaccccaaggaaccaaaccggccaaggtactccaaccgttcgacttacggtggaagactacgctacgttcgaaccttaaaagttaaactttttcggttaacttacggtaaccctaaagtacgaacgtaccgacggcccacggtacccctggtcccgttaggtacttagtttagtacggaacgtaccgacacggccgtaccctgaacgtcctaccgtggacgttagttcctcgacggactacggactacggtacggaacctaggttccgacctacgttcgtaccttactcccgacggtccggtaccgaaggggttcgaaggtacgtacgggaaacggttcgaaaccgtttaccgtttcgtttaccgttaacccttacggaaacccgagtaaacccctaggtagtaacccg

SEQ ID NO: 273915 - DNA, 865 bp, Homo sapiens
  misc_feature: GYAE6OF01BWURN.48.34.D01.1.454.CMB.1.raw
  modified_base (425)..(425): a, c, t, g, unknown or other
  misc_feature (425)..(425): n is a, c, g, or t
tcagagtatacatacacgaccggtgctcgatttagatcgtctgtgttggggttgggggctgtgggctcaggaggcagagctctgggaatctcaccatggcctggacccctctcctgcctccccctcctcactttctgcacagtctctgaggcctcctctgagctgacacagcccacccgtcggtgtcagtcgtcccgaggaccaaacggccaggactcacctgctcgtggagatcgcagttcgaccgtaaaagttaaaatttttggttaacttacgggtaacccaaacgtgtaagtacacgggccacggccccttgttcctggttactattttagcggaacggtaccgaccgaggacccgacccctcgaacggtaccttccccgtggtaccgtacggtttctccggtaggaactaaccggtaacnccggtaagggactacgtttaccggaccctacctttggaaacttcgtaccgaccggggttccggggacccggtaggggtagggtaacggtacggtaagggtaaacgggtacgtaaccgtttaaccgtttccgtttacgtttaccgttaacgtaaaccgtaacgtaacccgaacgtaacggtaaccgtaacgtaaacgtacgtacgttacggtaaccggtttaacgggttttaccggggaccggggtaaccggggtaaccggtaaaccggttacccggttaccgggtaaccccgggtttacccgggttaccggggtacccggtaaccccgggtaaccccggttaacccgggtaccccggttacccccgggtacccccccgggtttaccgggttaccccgtttaccccgttaccccgggttttcccggttaaccccccccccg

SEQ ID NO: 273916 - DNA, 247 bp, Homo sapiens
  misc_feature: GYAE6OF01CI3RH.48.34.D01.1.454.CMB.1.raw
  modified_base (244)..(247): a, c, t, g, unknown or other
  misc_feature (244)..(247): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccgccctctctatgtatactctgagcgggctggcaaggcgcatagnnnn

SEQ ID NO: 273917 - DNA, 401 bp, Homo sapiens
  misc_feature: GYAE6OF01B3EJT.48.34.D01.1.454.CMB.1.raw
  modified_base (396)..(401): a, c, t, g, unknown or other
  misc_feature (396)..(401): n is a, c, g, or t
tcagagtatacatacacgaccggtgctcgatttagatcgtctgtgttgggtttgggatctacgttgcaggtgtaggtctgggtgccgattcgcctctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnn

SEQ ID NO: 273918 - DNA, 639 bp, Homo sapiens
  misc_feature: GYAE6OF01AI9TH.48.34.D01.1.454.CMB.1.raw
  modified_base (271)..(271): a, c, t, g, unknown or other
  misc_feature (271)..(271): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtgctgttgtgtcaaatgatggacatgctgaatatgcagactccgtgacggggccattcgccttctccagagacaattccaagngctacggttcatctgacaaagtgacgccgcccgtagacgacctgaaccgacgacggctgtctattacgtgtcgcgagacgggtcgtaccgtaacgtttaacgacggtccggtacggggagtacttagttacgtttcgaacgtacgtcggggaccgtacgggtacccgtggtaccgaccgttctaccctacgacgtcccgtacccgaaccgacggcccctacgttcccgggttacccttcccccggtcggtcccgtacccgtcggaccgttcccgacggtaccgccgtacccgtccggacgaccgccgaccgacggccggcccgtcgggccttcgcccgtacggtaccgaaccggtcgttccgttaccg

SEQ ID NO: 273919 - DNA, 652 bp, Homo sapiens
  misc_feature: GYAE6OF01DJWIH.48.34.D01.1.454.CMB.1.raw
tcagagtatacatacacgaccggtgctcgatttagatcgtctgtgttgggtgcagttggtggaggtcggggggaggtgtggtccagcctgggaagtccctgacactgtcctgcgcagcctctggattcaccttcaccacctttcgtatgctactttgtccgccaggctccaggcaaggggctggagtgggtgctgttgtgtcaaatgatggacatgctgaatatgcagactccggtggaggggccgattccgccttctccagagaactaattccaagacgcacggttcatctgacaaaatgacgccgcctagacgacctagaacgacgacggtctcgtcttattactggtacgcggaggacgggtccgtaccgtaagtttaaccgacggtccgggtaggggaggtatttacgtttactttagaacgtaacggtcgggaccgtacgggaacccttggtcctaccgtcctcccacacgtccctaccgaaccgaaccgggccctacgttccggtccttcccccgtcggtcccgcccgtcgccgtccgaacggacgaccgaccccgtaccggaacgacgaccgaaccgaccgggcccggtaccccgtgggtccctcggtacccgtacggtaccgaacgggttcctcccgttacccg

SEQ ID NO: 273920 - DNA, 249 bp, Homo sapiens
  misc_feature: GYAE6OF01CY9JE.48.34.D01.1.454.CMB.1.raw
  modified_base (246)..(249): a, c, t, g, unknown or other
  misc_feature (246)..(249): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaagggcgcatagnnnn

SEQ ID NO: 273921 - DNA, 592 bp, Homo sapiens
  misc_feature: GYAE6OF01AXIQ7.48.34.D01.1.454.CMB.1.raw
  modified_base (299)..(299): a, c, t, g, unknown or other
  misc_feature (299)..(299): n is a, c, g, or t
tcagagtatacatacacgaccggtgctcgatttagatcgtctgtgttggggttgggggctgtgggctcaggaggcagagctctgggaatctcaccatggcctggacccctctcctgctccccctcctcactttctgcacagtctctgaggcctcctctgagctgacacagccaccctcggtgtcagtcgtccccaggacaaacggccaggatcacctgctctggagatgcattgaccaagtaaaattttgtattggtaccaactgaagtcaggccaggcccctgtcctggtctatttangaggacgaccagccgaccctcaggactcccgtgcgtaggttctcgtggactcgaactcgagggactagttcggccctacgttgactatccgacgtcggggcccgagggtggaggtagtaggaaggtagtacttacttcttgtttacctacaacagaccacgagtagaactaatacacgtagtacgttagtttcgggacggtacgggaaccgaacgtcgtacgaccgtccgtcggtacacggcccgacggtcctccggtcccccgtcggtacctccgttccgtccgttcccccg

SEQ ID NO: 273922 - DNA, 747 bp, Homo sapiens
  misc_feature: GYAE6OF01AOZM8.48.34.D01.1.454.CMB.1.raw
  modified_base (343)..(343): a, c, t, g, unknown or other
  misc_feature (343)..(343): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtggaggggccgattccgccttctccagagacaattccaagagctacggttcatctgacaaagtgacgccgccctggacgacctggaccgacgacggtctgtctattacgngtgcgaggaggccgtcgtaacgtttaacgcggtccggtaggggaggtacttactttacgtttcgaaccgtaaccggtcggggacccgtaacggggtaaccccttcgggtacccgtaacccgttccgttaccccgtaccgacccggtaccccgtaccccgaacccggtaaaccggggtccccctaaggttccccgggtttaccccgttccccccgtcgggccccgtccccgttacgccccgttaccggacgggacccgtacccgaccccggtcccggaaacggacccgtacccgaaccgggaccgggtcccccggtccccgggtcgggggttccccgtaccccggtcccggttaccgggttacccgaaaacccgggtttcccgtttaaccccgttttaaccccgg

SEQ ID NO: 273923 - DNA, 274 bp, Homo sapiens
  misc_feature: GYAE6OF01BEGC5.48.34.D01.1.454.CMB.1.raw
  modified_base (246)..(246): a, c, t, g, unknown or other
  misc_feature (246)..(246): n is a, c, g, or t
  modified_base (251)..(274): a, c, t, g, unknown or other
  misc_feature (251)..(274): n is a, c, g, or t
tcagagtatacatacacgaccggtgctcgatttagatcgtctgtgttgggtttggggggtgtggtggtctccacctcccgccttgacgaggctgattactactgtcagtcttttgataacaacaatcacgtggtcttcggcggaggaccagcctgaccgtcctaggtcagcccaaggctcgcccccgtggtcactctcgttcccaccctcctctatgtactactctgagcgggctggacaaggcgnatagnnnnnnnnnnnnnnnnnnnnnnnn

SEQ ID NO: 273924 - DNA, 250 bp, Homo sapiens
  misc_feature: GYAE6OF01B7UK9.48.34.D01.1.454.CMB.1.raw
  modified_base (241)..(241): a, c, t, g, unknown or other
  misc_feature (241)..(241): n is a, c, g, or t
  modified_base (247)..(250): a, c, t, g, unknown or other
  misc_feature (247)..(250): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaagggcncatagnnnn

SEQ ID NO: 273925 - DNA, 684 bp, Homo sapiens
  misc_feature: GYAE6OF01DBH0A.48.34.D01.1.454.CMB.1.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
tcagagtatacatacacgaccggtgctcgatttagatcgtctgtgttgggtttgggggtgggctcaggaggcagagctctgggaatctcaccatggcctggacccctctcctgcctccccctcctcactttctgcacagtctctgaggcctcctctgagctgacacagcccaccctcggtgtcagtcgtccccaggacaaacggccaggatcacctgctctggagatgcattgacaaagtaaaattttgtaattggtaccaatgaagtcaggccacggccctgtcctggtctagtttangagacaccagccgacctcaggactcccgtgcgtagttcncgtggatcgaactcgagggtacacgttggaccctaccttgaacctagtccgaacggttcggggacccaggggtacggaaggtagtaggtaaggttacgtaacgttacgtttcgtttacggtttaccttacctaaaccgaacggtaaacctaacccgaaggttacgaaactaaacttactaagttacggaccgttacggttttacgggaaccgggtaacgggaaccgaacggtccgtacggtacccggtccggttacgggtaccgaaccggaccgaaccggtccgtaccccggtcccccgtccggttacccaaccgttccgtcccgtttcccccgccctttaccccg

SEQ ID NO: 273926 - DNA, 782 bp, Homo sapiens
  misc_feature: GYAE6OF01A1VBA.48.34.D01.1.454.CMB.1.raw
tcagagtatacatacacgaccggtgctcgatttagatcgtctgtggttggggtggggctgtgggctcaggaggcagagctctgggaatctcaccatggccctcggacccctctcctgcctccccctcctcactttctgcacagtctctgacggtcctcctctgacgctgaccacacgcccacccgtcggtgtcacggtccgtacccccgaggaaccgaaacggccgaggactccaccgtgcctcgtggacgagtcgctattcgacctaaagttaaattttgttaagttcggtaacctaacgtaggaacgtcggaacggtccaccggtcccctacggttccgttggtacctaagtttacgaggacggaccgaccgacggtacccacccgtacgaacggtacctccccggtggtaccggttaacgtttccgtaccggtacggacgtaccgtaaacgtcggacgggtactaggttccggaccctacgttagaccttagtcccgacggttacccgggaccgtagggtacggaaggtacgtagggtaacggtcgtaacgttaccgtttcgttaccgtttacgtaaccaacgtaacgtaaccgaccgtagtacgaactaactacgtagtaccgtacggttaccgtttacggaccggtaacgggtaccaacggtccgtaccggtaccggtccggtaccgggtacccgaccggtaaccccgtacggtacccgtaccccggtacccccgttaccggtacccgttacccgttcccgttccccgttacccccg

SEQ ID NO: 273927 - DNA, 836 bp, Homo sapiens
  misc_feature: GYAE6OF01A33DK.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctactttgtccgccaggctccgaggcaaggggctggagtgggtggctgttgtgtacaaatgatggacatgctgaatatgcagacctccggtggacggggcctattccgccttctccgagacgactaacttaccgaagacgctacggttcatcgtgacaaagtggacgcccgcccgtaggacgtacccgtaggaccgtaccgaccgggtcttcgttaccttaagtttaccgtggtacggacgggtaacgggtacggggtcccgttaacccggtaacgttttaaacccgaccgggtcccggggtacggggtaagggtaactttacgtttaacgtttacggaaccctaacgggtcgggggacccgtaacggggtaaccccttgggtaccctaacccggttcctacccgtccgaccggtccccgtaccccgaacccggaaccggggtcccctaacggtttccccgggttaccccctttccccccggtcgggtaccccgtccccgttaccggccccttacccgggacggacccgtaccctaccccggtaccggacggaacccgtacccgaacccgggtaccggggccccgggttacccccgggttcggggtccccgttaccgggtaccccggggtttaccgggtaacccggtaaaacccgggtttccccgttttaaccccggttttacccgg

SEQ ID NO: 273928 - DNA, 248 bp, Homo sapiens; identical to SEQ ID NO: 273874
  misc_feature: GYAE6OF01AN4FV.48.34.D01.1.454.CMB.1.raw
  modified_base (246)..(248): a, c, t, g, unknown or other
  misc_feature (246)..(248): n is a, c, g, or t

SEQ ID NO: 273929 - DNA, 667 bp, Homo sapiens
  misc_feature: GYAE6OF01B7VI9.48.34.D01.1.454.CMB.1.raw
  modified_base (252)..(252): a, c, t, g, unknown or other
  misc_feature (252)..(252): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgcttcnccagagacaattccaagagcacggttcatctgacaaatgagccgcctgacgacctgacgacacggctgtctattacgtgtagcgaggacgggtcgtccggtaagtttaacgcggtccggtacggggaaggtacttagtttacgttagacgtaacggtcggggaccaacggggtaacccctggtaccctaccggtcctaccgtcgacgtccctacccgaaccgaacgggtccccctaacgttcccggttacccttcccccggtcggccccgtccccgttcggccccttaccggacgggtaccacccgtaccccgtccggaacgtaccgaccgtaccggacggccccgggccccggttaggggcccttcgggacccgttcgggtaacccgtaaccgggtacccttaccgtttaaccg

SEQ ID NO: 273930 - DNA, 304 bp, Homo sapiens
  misc_feature: GYAE6OF01EJSJI.48.34.D01.1.454.CMB.1.raw
  modified_base (259)..(304): a, c, t, g, unknown or other
  misc_feature (259)..(304): n is a, c, g, or t
tcagagtatacatacacgaccggtgctcgatttagatcgtctgtgttggggtttcgggggtagtggtggtctcccactcccgccttgaccgaggctgattaactactgtcagtcttttgataacaacaatcacgttggtcttcggcggagggaccagcctgaccgtcctaggtccagccccaaggtctgccccctggtcactctgttcccgccctcctctatcgtactactctgagcgggtctggcaaggcgtcatagnnnnnnnnnnnnnnnnnnnnnnnnnnnnnnnnnnnnnnnnnnnnnn

SEQ ID NO: 273931 - DNA, 716 bp, Homo sapiens
  misc_feature: GYAE6OF01EJUUK.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgctactttgtccgccaggctccaggcgaaggggctggagtgggtggcttgttgtgtcaaatgatggacatgctgaatatgcagacctccggtggacggggccgtagttccgtcctttctaccgagtacgaaccaacttaccgaaaggacgtccgtaacggtttacaacttcgtagtacaaaagtggacgccgacccgtaggacgaccgtcgaccgacgacggtcttacgtactacgttacgtggtcggacggagggtacgggtccggtaccggtaacgtttaaccgaccgggtacccgggtacgggtaaggtacgtttaacgtttacgtttacggaaccggtaacgggtcggggtaccgaaccggggtacccgtcggtacctaccggttcctaccgtccacggtcccaccgtaaccgaccggtccctacgtcccggttccctccccggtcggcccgtccgtcgacctaccggaggacccgctacccggtccggaacgacggacccgaggtaccggcccggtccggcggtccgtaccggtcccgtaggtaccgaacgtccttcgttaccg

SEQ ID NO: 273932 - DNA, 581 bp, Homo sapiens
  misc_feature: GYAE6OF01CKOGL.48.34.D01.1.454.CMB.1.raw
  modified_base (363)..(363): a, c, t, g, unknown or other
  misc_feature (363)..(363): n is a, c, g, or t
  modified_base (489)..(489): a, c, t, g, unknown or other
  misc_feature (489)..(489): n is a, c, g, or t
  modified_base (513)..(513): a, c, t, g, unknown or other
  misc_feature (513)..(513): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaaatgatggacatgctgaatatgcagactccgtgaggggccattcgccttctccagacgacaattccaaagagcacggttcatctagacaaatgacgccgccctgacgacctgacgacacggctgtctattactgtgacgagacggcgtacgtagttaacncggccggtacgggaggtattaatttacgtttagacgaacggtcggggaccgaacgggtaaccctggtcgtaccgtctccctacgacgtccctaccgaccgacggcccacgtccgtcccttccccgngcccgtcccgtgcctccgaggacnccaccgtccgagcgccacgacgccggcccgtcgggctcgtccgtacggtacaacggtccttacgttcc

SEQ ID NO: 273933 - DNA, 720 bp, Homo sapiens
  misc_feature: GYAE6OF01CEVX4.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactcgtgagggccattcgccttctccagagacaattccaagagcacggttcatctgacaaatgacgccgccctgacgacctgacgacacggctgtctattactgtgcgaggacgggctaccgtaagtttaacacggccggtacgggaggtattagtttacgtttgaacgtaacggtcggggaccgaacgggtaaccccgttgggtacctacccgttctccctcgaccgtccctacccgaaccgaaccgggcccctaacggttcccgggttacccctttccccccggtcgggtccccgtcccccgttccggccccttacccggaacgggtacccgacccgtaccccgttacccggaaaccggaccggtacccgaaacccggtaccgggccccgggtcccccgggttccgggggtacccgtttcccgggtaccccggtttaccggggtaacccggaaaaccggggttaacccctttaacccggttttaaccccgg

SEQ ID NO: 273934 - DNA, 250 bp, Homo sapiens
  misc_feature: GYAE6OF01DJCOQ.48.34.D01.1.454.CMB.1.raw
  modified_base (246)..(250): a, c, t, g, unknown or other
  misc_feature (246)..(250): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnnnnn

SEQ ID NO: 273935 - DNA, 270 bp, Homo sapiens
  misc_feature: GYAE6OF01CI5UF.48.34.D01.1.454.CMB.1.raw
  modified_base (240)..(240): a, c, t, g, unknown or other
  misc_feature (240)..(240): n is a, c, g, or t
  modified_base (247)..(270): a, c, t, g, unknown or other
  misc_feature (247)..(270): n is a, c, g, or t
tcagagtatacatacacgaccggtgctcgatttagatcgtctgtgttgggtttggagggtgtggtggtctccactcccgccttgacgaggctgattactactgtcagtcttttgataacaacaatcacgtggtcttcgggcggagggaccagcctgaccgtcctaggtcagcccaagctcgccccctgtcactctgttcccaccctcctctatgtatactctgagcgggctggcaaggcnctatagnnnnnnnnnnnnnnnnnnnnnnnn

SEQ ID NO: 273936 - DNA, 797 bp, Homo sapiens
  misc_feature: GYAE6OF01DABZR.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctagaatatgcagactccggtggaggggccgattccgccttctccagacgactaacttccaagacgcacggttcatctgacaaatgacgccgccctaggacgacctagaaccgacgacggcttgtacttattacgtgttacggacggaaggtacggggtccgttacgtaacggtttaaccgaccgggtccgggttaggggaacgggtatttaacgtttacgttttacggaaccggtaaacggtcgggggaacccctaacgggggtaaacccctttcggggtaacccgtaacccggttcccttaccccgtacccgacccggtacccccgttaccccgaaacccggtaacccggggtacccctaaccgggtttccccgggtttccccctttccccccggtacgggaccccgttccccggttcggccctacccggtaacgggacctaccccgtaaccccgtacccgggacgaaccggacccgtaacccggacgggcccccgggttccccgttccggggggccgttaccggtcccgggtttaacgggtacctaaaccggggtacccttttacccggtttaacccg

SEQ ID NO: 273937 - DNA, 609 bp, Homo sapiens
  misc_feature: GYAE6OF01BCZCI.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtgctgttgtgtcaaatgatggacatgctgaatatgcagactccggtgaggggccattcgccttctccagagacaattccaagacgcacggttcatctgacaaatgagcgccctgacgacctgacgacacggctgtctattactgtgcgagacgggtcgtccgagtttaacgacgccggtcgggaggtatagttacttgactacgtgggccagggaccctggtccaccgtctccctcgacgccctccaccgacgggccccagtcccgggtccttcccccgtggcccgtccccgtgtacccgtacccgaggaccgcctaacccgtccggaacgacggccgaacccgacggcccgggtccccgttacggggcccttccggtaccccgtgggttaacccgaacgggttacccttaccgtttaccg

SEQ ID NO: 273938 - DNA, 600 bp, Homo sapiens
  misc_feature: GYAE6OF01E3ZRI.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacccaccttttcgtatgcacttttgtccgccaggctccaggcaaggggctggagtgggtggctgttgtgtcaaatgatggacatgctgaatatgcagactccgtggagggccattcgccttctccagagacaattccaagagcacggttcatctgacaaatgagcgccctgacgacctgacgacacggctgtctattcgtgtgcgaggagggcgtaccgtagtttaaccgacggtccggtgggaggattattactttagactaacgtcgggccgaggaccctggtccaccgtctcctcgacgcctccgaccgacggcccacgtccggtcccttcccccgtggcccgtccctcgtccctccgacggacgtccacccgtccggaacgacgccgaccgacggcccgggccccgtacggggtccctcggtcccgttacgggtaccgaacgggtaccttaccggtttacccg

SEQ ID NO: 273939 - DNA, 250 bp, Homo sapiens
  misc_feature: GYAE6OF01AZABP.48.34.D01.1.454.CMB.1.raw
  modified_base (247)..(250): a, c, t, g, unknown or other
  misc_feature (247)..(250): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgcccccctcggtcactctgttcccaccctcctctatgtatactctgagcgggctggcaaggcgcatagnnnn

SEQ ID NO: 273940 - DNA, 249 bp, Homo sapiens
  misc_feature: GYAE6OF01E1B4L.48.34.D01.1.454.CMB.1.raw
  modified_base (247)..(249): a, c, t, g, unknown or other
  misc_feature (247)..(249): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttccccgccctcctctatgtatactctgagcgggctggcaaggcgcatagnnn

SEQ ID NO: 273941 - DNA, 899 bp, Homo sapiens
  misc_feature: GYAE6OF01DZXEI.48.34.D01.1.454.CMB.1.raw
tcagagtatacatacacgaccggtgctcgatttagatcgtctgtgttggggttgggggctgtgggctcaggaggcagagctctgggaatctcaccatggcctggacccctctcctgcctccccctcctcactttctgcacagtctctgagcctcctctgagctgacacacgccacccgtcggtgtcagtcgtcccaggacaaacggccaggatcacctgctcgtggagatcgctagttcgaccgtaaaagttaaaatttttggtttaagttacggttaaccctaaacgttacggtaaacggttaccgaacgggtacccgtaaccgggtccccccttggttccccgttagggttacctttaagttttaacgtcgggaacgggtaacccgaaccgacggacccgtacccccgtaccggacgggtaccttccccgtcggtaccgggttaacggtttccgttaccgttacggtaacgttaccgtaaaccgtaccggaacgggtaactacgtttcccgggacccttaccgtttacgaacttacgtaccgtaccgggttccgggggacccgtaggggtacgggtaacgggtaggttaacgggtaaacgggttacgtaaccgttttaccgtttcgtttaccgttttacctaacccgtaacgtaaccgtaacccgtaaccgtaacggtaacgtaaactaacgttaacgtagttaccggtaccggttttacgggttttacccggggaacgggtaaccggggaaccgtaacgggtccgttaccgggtaacccggttacccgggtacgggtacccgaacccggtaaccccggaccgggtacccgtcccccgggtacccccggtttaccggtaccccgttacccgtttcccgttcccgtttaccccccccg

SEQ ID NO: 273942 - DNA, 803 bp, Homo sapiens
  misc_feature: GYAE6OF01DMCYF.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtcccgccaggctccaggcaaggggctggagtgggtgctgttgtgtcaaatgatggacatgctgaatatgcagacctccggtggacgggccgtattccgcctttctccgaagacgaacctaattcccgaaagtacgtcgtaaccggtttcaacgttccgtgaaccgtaaaagttggaaccgcccggtacccttaggaaccggttaccgtaggaaccgaccgtacggtcttacgtttctaagtttacgtggtacggacggaacggtcggggtacccgtttaccgttaaacggtttaaccgacccgggtcccgggttacggggaaggtttaactttaacgttttaccggtttacggaaaccgtaacgggttccgggggaacccgtaacggggtaaccccttcggtaccgtaacccgttctacccgtaccgacgtacccctacccgaaccggtaaccgggtcccctaaccggttcccggttaccccttcccccgtgggacccccgtcccgttcggacccgtcccggaaggacccgtacccgtaaccccggtaccggacgaaccggccgtaaaccggccgggtccccgggtacccgttcgggtcctaccgggtcccttagggtacccgaaaccgttcccgttccttaccccg

SEQ ID NO: 273943 - DNA, 672 bp, Homo sapiens
  misc_feature: GYAE6OF01ALT3P.48.34.D01.1.454.CMB.1.raw
  modified_base (316)..(316): a, c, t, g, unknown or other
  misc_feature (316)..(316): n is a, c, g, or t
tcagagtatacatacacgaccggtgctcgatttagatcgtctgtgttgggtttgggggtgggctcaggaggcagagctctgggaatctcaccatggcctggacccctctcctgcctccccctcctcactttctgcacagtctctgacggcctcctctgagctgacacacgcccaccctcggtgtcagtcgtccccaggaccaaacggccaggactccacctgctctggagatgctattcgacctaaagttaaattttgtagttcggtaaccaacgtgaacgtcgacggccacggtccctgtcctggtctatttagngacggacacgacgccgaccctacgaggtactcccgtgcgtaggttctcgtagactacgaactcgaggactagttcggaccctacgttagactacgtccgacggtcgggacctaggtggagtagtaggtaggtacgtacttacgttcgttgttactacaacgtacgactaacgtagtacgaactactacgtagtcgtacgttacggtttaccgggacggtacggtaaccgacggtacgtaccggtaccggttcggtaccgggtaccgtaccggacccggtaaccggtcccgttacccgtacccccgttaccggtacctacccgttcccgttaccccgttccccgtacccgttacccg

SEQ ID NO: 273944 - DNA, 259 bp, Homo sapiens
  misc_feature: GYAE6OF01DPNBX.48.34.D01.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (249)..(259): a, c, t, g, unknown or other
  misc_feature (249)..(259): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcgggagggaccagcctgaccgtcctaggtcagcccaaggctcgccccctcggtcnctctcgttcccgccctcctctatgtatactntgagcggctggcaaggcgcatagnnnnnnnnnnn

SEQ ID NO: 273945 - DNA, 249 bp, Homo sapiens
  misc_feature: GYAE6OF01AC5DH.48.34.D01.1.454.CMB.1.raw
  modified_base (247)..(249): a, c, t, g, unknown or other
  misc_feature (247)..(249): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnn

SEQ ID NO: 273946 - DNA, 831 bp, Homo sapiens
  misc_feature: GYAE6OF01AIN1Q.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctacttttcgtccgccaggcctccgaggcgaaggggctggaggtgggtgcttgttgtgtacaaagtgagtggacatgctagtaatagtgcagtaccgtccggtagggacgggccgtacttccgtcctttccgtaccgagaacgactaacgttaccaaggacgcgtacggttcagttctacgactaaagtcggaccggccgtccgtaggaaccgtaccgtacggaaccgtacgacggttccttagttaccttagtttaccggtggtacggaacgggtacggggtaccggggtaccgttaacccggttaaacgtttaaccggacccggggttaccggggtacggggttaaggttaattttaacccgtttaacgttacggtaaccgtaccggggttaccgggtaacccgggtaacccgggtacccgttcccggtaccctacccggttccctaacccgtccgtaccgtccctaacccggaacccggtaccggtccccgttacgttcccccggttccccgttcccccgggtcggtccccgtcccgttccgaacccgtccggaccgggtacccgaccccggtcccgacggtacggaccgtaaccgaccggtaccgggccccggtccggtccggtacgttacccggtccggttacggaacccgttaacggttcccgtttacccgtaccg

SEQ ID NO: 273947 - DNA, 741 bp, Homo sapiens
  misc_feature: GYAE6OF01EORSI.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgctactttgtccgccaggctccaggcaaggggctggagtgggtgctgttgtgtacaaatgatggacatgctagaatatgcagacctccgtggacgggcctattccgccttctccagagaactaattaccaagcgctacggttcatctagacaaatcggacgccgccctaggacgaccgtggaaccgaccgacggtcttacgtacttattacctggtacgcgacggacgggtccgtaccgtaagtttaacccgacggtaccggtagggtaaggtatttactttaacgtttacgaacgtaccggtcgggacctaacgggtaaccctgaccgtaccgtctacccgtacgaccgtccctaccgaccgaacggtccctacgttcccgttaccccttcccccggtggaccccgtccccgtacggtaccctccggaacgggtacccgtcccgtaaccccggtccggaaggtaacccggacccgtaaccgggtaccgggtccccccgggttacccgttccgggggtaccccttaccgggtaccccggttacggttaaaccccggtaaaaccccgggttccctttaacccggttttaacccgg

SEQ ID NO: 273948 - DNA, 755 bp, Homo sapiens
  misc_feature: GYAE6OF01DWDB1.48.34.D01.1.454.CMB.1.raw
  modified_base (334)..(334): a, c, t, g, unknown or other
  misc_feature (334)..(334): n is a, c, g, or t
tcagagtatacatacacgaccggtgctcgatttagatcgtctgtgttgggtttgggcacgaccggtgctcgatttagatcgtctgtgttgggtttggcacgaccggtgctcgattagtatcgtctgtgttgggtttggggtcgtgtgggcgtcaggaggcagagctctgggaatctcacatgccgtcgaccctcctcctcgcctccccctcctctacttctcgcacacgtctctgacggtcctcctcgtagacgctacgacaccagccctacccgtggtgtcacgtccgtcccgaaggacgaaccggcaggtactccaccgtgctacgtagganactcgctacgtttacgaacctaaagttaaaatttttcgttgttaacggaacaacttggaaactcgaccggcctccggacccttcgtacctggttctaacgttttaagcgggaaacgggaccaacccgtacggccccgtaacccccgtcgtaacggggacttccccgtagggtacgttaccgggtttcacgggtacgtacgttaacccgaaccgtgaacgggtactacgtttccggacccttacgttaccgtaattacgttcccgaaccggtcgggggaacccgtgggttaaagggggcgttaagtaaaccggggttaaacgggttaaccttcccgttttaaacggttttccccggtttgtttttaaacccccgaaccggaaaaacggtccccggtaaaacccctcgggtaaacgttacggg

SEQ ID NO: 273949 - DNA, 694 bp, Homo sapiens
  misc_feature: GYAE6OF01BRIZW.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacccacctttcgtatgcactttgtccgccaggctccaggcaaggggctggagtgggtgctgttgtgtcaatgatggacatgctgaatatgcagactccggtggaggggcctattccgccttctccagagacctaattccaagacgcgtacggttcatctgacaaatgacgcgccctagacgacctgacgacgacggtctagtctattactggtgacgtaggacggtcgtaccgtaacgtttaacgccggtccggtaggggaggtacttacgtttacttaggaactaacgggtcgggaccgacgggtaacccctgggtaccgtaccgttccgtccctcgaccgtccctacccgaaaccggtaccgggtacccttacggttccccgggttccccttacccccggtcggtaccccgtccccgttacggcccttacccggacgggtacccgtaccccgtacccgtaccgaacggtaccgaccgtaccgacgggtccccgggtcccgtagggtcccctacgggtacccgtacgggaccgtaaaccgggttccttaacccgttaccg

SEQ ID NO: 273950 - DNA, 708 bp, Homo sapiens
  misc_feature: GYAE6OF01D2HZ8.48.34.D01.1.454.CMB.1.raw
  modified_base (292)..(292): a, c, t, g, unknown or other
  misc_feature (292)..(292): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacccaccttttcgtatgcacttttgtccgccaggctccaggcaaggggctggagtgggtggcttgttgtgtcaaatgatggacatgctagaatatgcggactccggtggaggggcctattcgccttctccagagacaacttccaagagcacggttcatntgcaaagtgacgccgcctgacgacctgacgacgcggctgtcttattactgtcgcggagtacgggcgtaccgtaagtttaaccgacggccgggtacgggaggtacttagtttacgtttagaacgtaacggtcgggacccgtaacggggtaaccccttcgggtaccctaccggttccttacccgtccgtaccgtccccgtacccgaaccccggtaacggggccccccttaacggtttccccgggtttaccccctttccccccggtcgggcccccggtccccgtcggtcccgtacccggacgggaccgtaccctacccgtaccggacggacccgaccgaaccggccggacccggggtccccgtcggggcccttcggaccgttcgggtaactaaacggtaccctttaccgttccgttacg

SEQ ID NO: 273951 - DNA, 756 bp, Homo sapiens
  misc_feature: GYAE6OF01C7NDQ.48.34.D01.1.454.CMB.1.raw
  modified_base (234)..(234): a, c, t, g, unknown or other
  misc_feature (234)..(234): n is a, c, g, or t
  modified_base (615)..(615): a, c, t, g, unknown or other
  misc_feature (615)..(615): n is a, c, g, or t
tcagagtatacatacacgaccggtgctcgatttagatcgtctgtgttgggtgcagttggtggaggtcgggggaggtgtggtccagcctgggaagtccctgacactgtcctgcgcagcctctggattccaccttcacctacctttcgtatgctactttcgtccgccaggcctccaggcgaagggctggagtgggtgcttgttgtgtacaaagtgagtgacagtgctagaattagngactaacgccgtccgggtagggacggggtcccgtagtttcccggtcctttaccgtacccgaaggaacgtaaccttaaacttacccgaaggaacgtccgtaacggttcactcgtacgaacctaagtcggaacgcccgtacctagaacgtaccgacgaaccgaccgacgtcttcgttaactagttacgtcggtaggaccgggaaggtcggtaccggttaccgtaacgtttaaccgcggggtcggttacgggaaggtactttaacgttcgttacggaccgaacgggtacggaccgaccgggtacctcggtaccctaccggtcctccgtacgtaccaccctaccggaaccgtaccggccctacggttacccgttcccgtccccgnggtcccgacccgtcgaccttacggacgtacctcccgacgtccggaacgtacgacccgtaccgggaccgggcccggccgttcggggtccctacccgggtcgttaacggaaccggtaaccccgtttaacgttcctttaaccgg

SEQ ID NO: 273952 - DNA, 690 bp, Homo sapiens
  misc_feature: GYAE6OF01EVKN2.48.34.D01.1.454.CMB.1.raw
  modified_base (275)..(275): a, c, t, g, unknown or other
  misc_feature (275)..(275): n is a, c, g, or t
  modified_base (596)..(596): a, c, t, g, unknown or other
  misc_feature (596)..(596): n is a, c, g, or t
tcagagtatacatacacgaccggtgctcgatttagatcgtctgtgttgggtggcagttggtggaggtcggggggagtgtggtccagcctcgggaagtccctgacactgtccctgcgcagccttctggattcaccttcacctacctttcgtattcgctactttgtccgccagggctaccaggcaaggggctggagtgggtgctgttgtgtcaaatgatggacagtgctgaactactcgccagaccgtccggtggacggggcctattccgcctttcnccagacgaactaattcccaaagcgcacggttcaagtcgtgacaaagtcggacgccgtcccttagacgtcccgttggacgtacgacggtcttggtccttattacgtgtcgcgaggacgggtcgtacggtaagttaaccgcggtccggtgggtaaggtattactttacgtttcgaacctaacggttcggggacctaacggggtaacccttggtacctacccgttctacccgttcgacgtcccgttaccgaacccggaacgggtccctagttccggttaccctttcccccgtggacccgtcccgtaggtcctaccgacggtacnccgtacccgtccggacgtactccgacgtacgggtccggtcccgtgggtaccctcggtacccgttgggtaccgaaacggttcctaacgttaccgg

SEQ ID NO: 273953 - DNA, 260 bp, Homo sapiens
  misc_feature: GYAE6OF01DSQ5O.48.34.D01.1.454.CMB.1.raw
  modified_base (251)..(260): a, c, t, g, unknown or other
  misc_feature (251)..(260): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctcgccccctcggtcactctcgttcccgccctcctctatgtatactctgaggcgggctggacaaggcgcatagnnnnnnnnnn

SEQ ID NO: 273954 - DNA, 711 bp, Homo sapiens
  misc_feature: GYAE6OF01EHLLJ.48.34.D01.1.454.CMB.1.raw
tcagagtatacatacacgaccggtgctcgatttagatcgtctgtgttgggtgcagttggtggaggtcggggggaggtgtggtccagcctgggaagtccctgacactgtcctgcgcagcctctggattcaccttcaccacctttcgtatgcactttgtccgccaggctccaggcaaggggctggagtgggtggctgttgtgtacaaatgatggacatgctgaatatgcagactccggtgaggggccattccgccttctccagtagacaacttccaaagagcacggttcaatctagacaaaatggaacgccgcccgtgaacgaccctgaaccgacacggcttgtacttattactgtagcggaaggacggggtccgtaccggttaagtttaaaccgacgggtcccggtacgggggaaggtaattaacgtttacgtttagaaccaacggttcggggaccgaacggggtaaacccctgggtaccacccggttctcccgtacacgtcccctaccgaacccgaacgggccctacggttcccggttacccttcccccgtacgggcccgtaccccgtggtacccttaccgaacgggacgtacccgaaccgttacccggacggaaccgtaccgacccgtaacggggcccggtccccggtacggggtccctccgggtcccgttacgggtaacctaaaccgggtacctttacccgttaaccgg

SEQ ID NO: 273955 - DNA, 716 bp, Homo sapiens
  misc_feature: GYAE6OF01BXD1L.48.34.D01.1.454.CMB.1.raw
  modified_base (581)..(581): a, c, t, g, unknown or other
  misc_feature (581)..(581): n is a, c, g, or t
tcagagtatacatacacgaccggtgctcgatttagatcgtctgtgttgggtgcagttggtggagtcgggggagtgtggtccagccgtgggaagtccctgacactgtcctgcgcagcctcgtggattcaccttcgacctactttcgtatgctactttcgtccgcgaggcctccgaggcagggctggagtgggtgcgttgttcgtgtacgaaagtggacgtggactagtcgacttagaatagtgactacgtacctcggtggaacgggcctattccgacttctccgaagacgtaactaagttaccgaaggtaccgtacgtaaccggttcaacgttccgtacgaaacctaacggtcgaccgcccgtaccgtagaacgtaccgtaggaaccgtacgtacgtcttagtacttacgttacgtgagacgaggtacggcgttacgtaagttacgcggtacggtagggagtaattgtttacgtagtacgacggtcggaacgtaccggtacctacgtacgtaccgtcctaccgtacaccgtccccgtaccgaacgaaccggtcccttacgttacccggccctttacccccgngaccccgtccgtaccgaccgtacggaccgaccgtacccgacccgttacgacggacccgacgtaaccgccgggtcccgacccggtggtacccgtcgtccggttacggaaccgtaaccgttaaccgttcgttaaccg

SEQ ID NO: 273956 - DNA, 778 bp, Homo sapiens
  misc_feature: GYAE6OF01CGMR3.48.34.D01.1.454.CMB.1.raw
  modified_base (707)..(707): a, c, t, g, unknown or other
  misc_feature (707)..(707): n is a, c, g, or t
tcagagtatacatacacgaccggtgctcgatttagatcgtctgtgttgggtgcagttggtggagtcggggggagtgtggtccagcctgggaagtccctgacactgtcctgcgcagcctctggacttcaccttcaccctacctttcgtatgctactttcgccgccaggcctccaggcgaaggggctgggaggtgggtggctgttgtcgtacaaatgatggacagtgctagaatagtgacacggaccgttccggtggacgggggtccctagtttcccgtcctttaccaccgtagaacgtaacctaaacgttccgaaaagcggaccgttaccggttacacttccgtacgaacgtaaacgtcggacgcccgacccgttaggaaccgaccgtacgaaaccggaccgtcgggtcttacggttacttaacgttaccgtaggtcggacgggacgggtaccgggtaccgttaaccggtttacggttaaaccggaccgggtaccgggggttacgggaaagggttaccttttaaacggtttacgtttaacggaccgtaaccgggtaccggggaccgtaaccgggtacccgttcggtcccgttaaccgtccgtcccgacgtcccgacccgtacccgaacccgaacccggtccctacggttccccgttccgtccccgtcggaccctcccgtcgccgtacgacgccctaccgaccgtacgngacccgcgacggtccgacccggtccggcggtctcccggtaccgtacgacgaacttccccgttacgttcccg

SEQ ID NO: 273957 - DNA, 763 bp, Homo sapiens
  misc_feature: GYAE6OF01BSEEH.48.34.D01.1.454.CMB.1.raw
  modified_base (231)..(231): a, c, t, g, unknown or other
  misc_feature (231)..(231): n is a, c, g, or t
tcagagtatacatacacgaccggtgctcgatttagatcgtctgtgttgggggttgggggctgtgggctcaggaggcagagctctgggaatctcaccatggcctggacccctctcctgcctccccctcctcactttctgcacagtctctgacggcctctctgagctgacacacgcccacccgtcggtgtcagtcgtcccaggacaaacggcagactcactgctcgtagagangtcagtcgacctaaagttaaattttgtagttaggtaacctaacgtggaacgtcaacggtccgtacggtccccttagtccgtggtactaagtttacgtaggaacgggacctaacccggacgaccgtaccccgtacgaagggtacctcccgtaggtaccgtaggtttcctcggtacggtaacttacggaacctacgacgggtaactacggttcggacccttaacgttcgtaacctacgtaccgtacgggtccggggtaccgtagggtagggacggaggtaggtaagggtacgtacgtttacgttcgttacgtttaccgtacgtaacgtaacgactaaccgacgtacgtaacgtaactactacgttacgtcggttaacggtttacggggacggtaacgggtaccgtaacggtaccgtaccgggtacccggttaccggtacgggtaccgaccggtaacccggaccggtacccggtacccccggttaccccggtaccggtacccgttaccccgtttcccgttaccccgttacccccg

SEQ ID NO: 273958 - DNA, 259 bp, Homo sapiens
  misc_feature: GYAE6OF01AQ1N2.48.34.D01.1.454.CMB.1.raw
  modified_base (248)..(259): a, c, t, g, unknown or other
  misc_feature (248)..(259): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgcccccctggtcactctgttcccccgccctcctctatgtatactctgagcgggctggcaaggcgcatagnnnnnnnnnnnn

SEQ ID NO: 273959 - DNA, 748 bp, Homo sapiens
  misc_feature: GYAE6OF01AP1TO.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtcccgccaggctccaggcaaggggctggagtgggtgctgttgtgtacaaatgatggacatgctagaatatgacagacctccgtggacggggcctattccgccttctccaagacgacaattccaaagcgctacgtcatctagacaaagtcgacgccgacccttaggaacgtacccgtacgaaccgacgtaacggtcttgttactaacttacgtgttacggacggtaacgggtacgggtccgtttaaccgtaacggttttaaacccgccgggtaccgggtaacggggtaggttaactttaacgtttaaccgtttaggaaccgtaaccggtacggggtaccgaacgggttaacccgtcgtaccgtaccgtcttacccgcgtaccgtcccctacccgaaccgaccggtaccctacgtacccgttcccgttccccgtcggaccccgtcctacggacccttcccggacgtaccgacccgtacccgtacccggaagtaccgccgaaccggcccgggtcccggtccccgttcggggtacccacccgggttcccgttaacgggtaacccgtaacccgggttaccctttacccgtttaaccgg

SEQ ID NO: 273960 - DNA, 268 bp, Homo sapiens
  misc_feature: GYAE6OF01B8IWJ.48.34.D01.1.454.CMB.1.raw
  modified_base (255)..(268): a, c, t, g, unknown or other
  misc_feature (255)..(268): n is a, c, g, or t
tcagagtatacatacacgaccggtgctcgatttagatcgtctgtgttgggtttgggggtgtggtggtctccactcccgccttgacgaggctgattactactgtcagtctttgataacaacaatcacgtggtcttcggcggagggaccagcctggaccgtcctaggtcagcccaaggcctcgccccctcggtcactctcgttccccgccctcctctatgtatactctggacggcggcgtggacgaaggcgcagtannnnnnnnnnnnnn

SEQ ID NO: 273961 - DNA, 667 bp, Homo sapiens
  misc_feature: GYAE6OF01AN1Y3.48.34.D01.1.454.CMB.1.raw
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtgctgttgtgtcaaatgatggacatgctgaatatgcagacctccggtggacggggcctattccgccttctccagagacattccaagngcacggtnatctgacaaatgacgccgcctgacgacctgacgacacggctgtctattctgtcgacgaggacgggtccgtacggtaacgtttaacgaccggtccgggtacggggtacggtattacgtttacgtttacgaacgtacggtcggggaccgaacgggtacccgtggtcctacccgttctcctacgaccgtccctaccgaccgacggccctacgtcccgttcccttaccccgcggtcccgtcccgtcgtcccgaccggacggtaccgcctaacccggtcggaacgaccgacccgtaccggtaccgggtcccgggtccccggtacggtcccggttccggtacccggttaccgggttaaccgaaccgggtttcccttaccgtttacccccg

SEQ ID NO: 273962 - DNA, 276 bp, Homo sapiens
  misc_feature: GYAE6OF01CXVQL.48.34.D01.1.454.CMB.1.raw
  modified_base (252)..(276): a, c, t, g, unknown or other
  misc_feature (252)..(276): n is a, c, g, or t
tcagagtatacatacacgaccggtgctcgatttagatcgtctgtgttggggtttggggggtgtggtggtctccactcccgccttgacgaggctgattactactgtcagtcttttgataacaacaatcacgtggtcttcggcggagggaccagcctgaccgtcctaggtcagcccaaggctcgccccctggtcactctcgttcccaccctcctctagtgtatactctgacggcgggctggcaaggcgcatagnnnnnnnnnnnnnnnnnnnnnnnnn

SEQ ID NO: 273963 - DNA, 755 bp, Homo sapiens
  misc_feature: GYAE6OF01B5VFZ.48.34.D01.1.454.CMB.1.raw
  modified_base (643)..(643): a, c, t, g, unknown or other
  misc_feature (643)..(643): n is a, c, g, or t
  modified_base (708)..(708): a, c, t, g, unknown or other
  misc_feature (708)..(708): n is a, c, g, or t
tcagagtatacatacacgaccggtgctcgatttagatcgtctgtgttgggtgcagttggtggaggtcggggggaggtgtggtccagcctgggaagtccctgacactgtcctgcgcagcctctggattcaccttcaccctaccttttcgtatgcctacttttcgtcccgccaggctccgagggcgaaggggctggagtggggtggcttgtttgtgtacaaatgatggacatgctagaatatgcagtaccgttccggtggacggggtccgtattccgtccctttactccgaaggaacgaacctaattacccgaaaggacgtaccgtacggttacaacttcgtagaacctaaagtcggaccgccgtcccgtagaccgtacctagaccgacacggtcttgtaccttattacgtggtcgacggtaggacgggtcccgttacgtaacggttaaccgaccgggtccgggtagggagtacttacgtttacgttcgaacgtacggtccgggaccgacggtacccgtgtacccgtaccgtcctccgtcgaccgtccctacccgaaccggaccggtccccgtacgttccccggtttacccttccccccggtacgggtccccgtccccgttacgtccccgtacgacgggtacccnccgtacccggaccggagtaaccggaccgacgggtacccggtcccggggtcccgtccggggttccncccggtaccggttacggtaaccgaaccggttaccttacccgttaccg

SEQ ID NO: 273964 - DNA, 662 bp, Homo sapiens
  misc_feature: GYAE6OF01EK7HS.48.34.D01.1.454.CMB.1.raw
  modified_base (267)..(267): a, c, t, g, unknown or other
  misc_feature (267)..(267): n is a, c, g, or t
  modified_base (570)..(570): a, c, t, g, unknown or other
  misc_feature (570)..(570): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgcactttgtccgccaggctccaggcaaggggctggagtgggtggctgttgtgtcaaatgatggacatgctagaatatgcagacctccgtggacggggcctattccgccttctaccaganaccaattaccaagacgcacggttcatctagacaaatgacgccgcctgacgaccgtgacgacgacggtctagttactactgtcggcggagacgggtccggtacgtacggttaaacgtaccgaccggtccggggtagggtagtttacttaagtttcgtaacgacggtaacgggtccggaaccgggtaccggttaccgtacgtaccgtacctccgtaccgacgaccgtaccccaccgtaacccggacccgtccgttaccgttcccgttccccgccggtccgacccgtccgtacgtccgacggtacnccgtacctccggtacgacgaccgaccgaaccggccggtcccgtcggtccggtacgttcggaccgttacggacgtaacgttccctccgttacg

SEQ ID NO: 273965 - DNA, 663 bp, Homo sapiens
  misc_feature: GYAE6OF01DHB73.48.34.D01.1.454.CMB.1.raw
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
tcagagtatacatacacgaccggtgctcgatttagatcgtctgtgttgggtttgggcacgaccagtgctcgatttagatcgtctgtgttgggtttgggcacgaccggtgctcgatttagatcgtctgtggttgggtttgggggctgtgggctcgaggaggcagagctcgtgggaactctcaccagtggcctcggacccctctcctcgcctccccctctctactttctgcacagtcctcgtgacggtcctcctctgacgctgaccacacgcccaccgtcggtcgtcacgtccgtacccgaggaaccgaacggccaggactccgacctgctcgngganatgctagttcgactaaagttaaatttgtacgttacggaacctaagtagaacgtcgacggccaccggtccctgtccgttggtactagtttacgacggacggtaccgaccgacgacccgtaccctacgacggtacctacccgtaggccggtagttctacgtaggacgtaccgtaacgtcgaagggtactacgttccggacctacgttcgacttacgtaccgtacggtcgggacccgtagggtacgggaggtacggtaacggtacggttacgtaccgtttaccgtttcgttaccgttactaaccgaacgtacgtaacccgtacgtaacgg

SEQ ID NO: 273966 - DNA, 907 bp, Homo sapiens
  misc_feature: GYAE6OF01D6E9G.48.34.D01.1.454.CMB.1.raw
  modified_base (139)..(139): a, c, t, g, unknown or other
  misc_feature (139)..(139): n is a, c, g, or t
  modified_base (144)..(144): a, c, t, g, unknown or other
  misc_feature (144)..(144): n is a, c, g, or t
tcagagtatacatacacgaccggtgctcgatttagatcgtctgtgttggggttgggggctgtgggctcaggaggcagagctctgggaatctcaccatggcctcggacccctctcctcgcctccccctcctcacttttcngcacngtctctgacgcccttcctctgacgctagaccacacgcccctaccccgtcggtcgtcgacggttccgtaccccgaaggaaaccgaaaccgggcctaaggactccacccgtgtccttcgtggaagtagtcgactagttacgaaaccgtaaaaagtttaaagtttttgttaacgttacggtaaaccctaaacgttaggaaacgttccggaaccggtacccgtaaccgggtccccttacggttcccggttacggttacctttaagttttaacggtcgggaaaccgggtaaccccaaccggtaacccggacccccgttaacccgtacccggtaaacgggtaccccctttccccggtacggggtaaccggtttaccgggttttcccgtaaccgggttaaccggaacttaacccggggtaaaccgtccggggtaaacgggtaacccttaccgggtttcccggaaccctttaaacccggttcgtaaaccgtttacccggtacccgtaccgggggtaccccggggtaccggtaaggggtacgggaaggtagttaacgggtacggtacgtaccgtttacgtttcgttacgtttacaacgaacacgtaccaggtaacacgtactagtcgtagtcgtacgttacggttcgggacgacggactacggtccgtaccggtacccggtcggtaccggaccaccggtaacccgtacggtccccgttaccccggtccccgttacggtccccttaccggttccccgtccccggttaaccccc

SEQ ID NO: 273967 - DNA, 802 bp, Homo sapiens
  misc_feature: GYAE6OF01COR9F.48.34.D01.1.454.CMB.1.raw
  modified_base (386)..(386): a, c, t, g, unknown or other
  misc_feature (386)..(386): n is a, c, g, or t
  modified_base (632)..(632): a, c, t, g, unknown or other
  misc_feature (632)..(632): n is a, c, g, or t
tcagagtatacatacacgaccggtgctcgatttagatcgtctgtgttgggtgcagttggtggaggtcggggggaggtgtggtccagccgtgggaagtccctgacactgtcctgcgcacgcctctggattccaccttcacctacctttcgtatgcctacttttgcccgccaggcctccgaggacgaaggggctgggaggtggggtgcgttggttgtcgtacaaaagtgaataggacagtgctagaatatgacaacgtaccgtccggtaggacgggggacctacgtttccgcctttacaccgaagacgaactaaactccgaaagagcctaacggttcactcgtagacaaagtcgacgccgtaccagacgactcgaacgtacgaccgtntcgtactaagttcgtggtacggacggtaggtacgggtaccgttaacggttaacgttaaaccggaccgggtaccgggtaacggggaaggttacttaacggtttaacgttacgaaacgtaccgggtcggggaaccccgtaaacggggtacccttacggtacccgtaaccttaccccgtcgtaccgacctaccccgtaacccaaacccgggtaacggcccttacggttcccggtaccccgtttccccgngggaccccgtcccgtaccgtaccggtaccgaaccggacccgacccgtaaccccggtacggaaccgtaccgacccgaaccgggtacccgggcccccgggttccggaaccggttccggacccgttaccgtaccgggttaaaccaaaccgggttaccttacccggtttaaccg

SEQ ID NO: 273968 - DNA, 720 bp, Homo sapiens
  misc_feature: GYAE6OF01DHPC9.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccctacctttcgtatgctactttcgtcccgccaggcctccaggcaaggggctgggagtgggtggctgttgtgtcaaatgatggacatgctagaatatgcacgtactccggtggacgggcctattccgccttctccagaacgactaacttaccgaagacgctacgttcatcctgacaatgacgccgcctagacgtaccgtgacgaccgacggctgttacttattacgtgtcgacggtaggcggtccgtaacggttaacgttaaccgaccggtccgggtaggggtacggtaactttacgtttacgttagaaccgtacggtccggggaccgtaacgggtaacccgtggtaccctaccgtcctacccgtcgaccgtcccctacccgaacggacccggtcccctacggttccccggttccccgttcccccgtacgggtcccccgtcccgtacgccccgtaccggacggtacccgaccgtacccccgtacggaccgtccgaaccgaccggtaccgggccccgggtcccggtcgggtacccgtccggtcccggttaacgggaaccgtaaccggtacccgttttaccttaccgg

SEQ ID NO: 273969 - DNA, 632 bp, Homo sapiens
  misc_feature: GYAE6OF01AGX67.48.34.D01.1.454.CMB.1.raw
  modified_base (234)..(234): a, c, t, g, unknown or other
  misc_feature (234)..(234): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
tcagagtatacatacacgaccggtgctcgatttagatcgtctgtggttggggttgggggctgtgggctcaggaggcagagctctgggaatctcaccatggcctggacccctctcctgcctccccctcctcactttctgcacagtctctgacggcctctctgagctgacacacgcccaccgtggtcgtcagtccgtaccccaggaccaacggccaggactcacctgctcgtgganatgactagtcgacctaaagttaaattttgtattacggacctaacgtgaacgtcgacggtccacggtcccctgtccttggtctagtttagnggacgacacgngccgacctcgagctccgtgcgtagtctcgagctacgactggaggtctagtcgacctacctgaacctgtcgacgggtcgggccgtagggtggacggtagtaggtacgtagtacgttacttcgttcttactacacgtacgactaccgtagacgaacactacgtagtcgtacgtacggtttcgggacggtacggaacgtacgcgtaccggaccgtaccggtcggtaccgaccgtcccggtaaccggtcccgtacccggtaccccgtccgtaccctccgttcccgttcccggttacccccg

SEQ ID NO: 273970 - DNA, 783 bp, Homo sapiens
  misc_feature: GYAE6OF01CTJNN.48.34.D01.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggtttggggctgtgggctcaggaggcagagctcgtgggaatctcaccatcggcctcggacccctntcctcgcctccccctctctactttcngcacagtctctgacgcctctctgagctgacacacgccctacccgtcggtgtctagtccgtacccccgaaggaacctaaaaccggcctaacggtacttaccgaacccgttcgtaccttcgtagggaacgctcggactaacgttacgaaccttaaaaggtttaaaactttttcggttaaacgtttaggtaacccgtaaacgtagggtaaaccgtcgaacccggtacccgtaacgggtcccccgttacggttacccgttagggtttaacttaaggttttacgaccgggaacggaccgaacccgtacggacccgtaacccgtaccgacgggtaaccttcccggtagtaccgtacggtttcacggtcggaactaccggtaacgtcggacggtaacgtacgtaccggtaccctaccgtttacgaaccgttactacccggtacggtccgggtaacccggtaagggtacggaacgtacggttaacggtaacgggttacgaacccgtttcggtttaccgtttacgtttaaccaaccgtaaacgacgaaacccgtacgtacggtaaaccg

SEQ ID NO: 273971 - DNA, 735 bp, Homo sapiens
  misc_feature: GYAE6OF01A5LTI.48.34.D01.1.454.CMB.1.raw
  modified_base (305)..(305): a, c, t, g, unknown or other
  misc_feature (305)..(305): n is a, c, g, or t
  modified_base (363)..(363): a, c, t, g, unknown or other
  misc_feature (363)..(363): n is a, c, g, or t
tcagagtatacatacacgaccggtgctcgatttagatcgtctgtgttggggttggggctgtgggctcaggaggcagagctctgggaatctcaccatggcctggacccctctcctgcctccccctctcactttctgcacagtctctgaggcctcctctgagctgacacagccaccctcggtgtcagtcgtccccaggacaaacggcagatcacctgctctggagatgcattcgaccaaaagtaaaatttttgtattggtaaccaacttgaagtcaggccaggtcccctgtcctggtcaagttttangtacggaccgaccgagccgtacccctcgagggactacccctggaccgtaggttttccncgtacggattacggaacctcgaggggtaactagtttcgggacccctaccgttttggaaccttaactcccgtacggttccgggggacccgtagggggtacgggaagggtacgtaggggtaaacggtacgtaaccttacgtttcgtttacgttttacctaaccgtaaacaacgtaaccaacccgtaggtacgtaacctaactactaacggttcgtacgttaacggttttccgggaccgggtaacgggaaccgtaacggtcgtaccggtacccggttccggttacgggtacccaccgggtacccggaacggtccccggtacccgtcccccgttacgggtacccttacccgttcccgttccccgtttacccccccg

SEQ ID NO: 273972 - DNA, 840 bp, Homo sapiens
  misc_feature: GYAE6OF01DUOIO.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctaccttttcgtatgctacttttgtcccgccaggcctccaggcaaggggctggagtgggtgctgttgtgtcaaatgatggacagtgctagaatatgacagaccgtccggtaggacggggtccgtacgttccgtcctttaccgtaccgaaggtaacgtaactaaacgttacccgaaaggacggtaccgtacggttactaacgttccgtacgaaactaaaaggtcggaaccggcccgtacccgttaggaacgtaccgtacggaaccgaaccgtaccgggtacttacgtacttaacgtttaccgtggtacggacgggtaagggaccgggtaccgttaaccggttaaacggttaaccgtaccgggtacccgggtacggggtaacggttaacgtttacgtttaccgttagtaaccggtaaccgggtccgggggtacccggtaacgggtaccccgttacggtacccgtacccgttacctccccgttaccgacccgttccccgacccgtaaacccgggaccggtaccctaccggtttcccggttacccctttccccgggtacggtccccgtcccgtccgtacccgtaccgaaccggtacctaccgtaccccgtcggaacgaccggacggtaacccggtaccggccccggtcccggtacggtcccgtccggtaccgtacgggttaacgtaaccgtccgtttaacccgttaccg

SEQ ID NO: 273973 - DNA, 889 bp, Homo sapiens
  misc_feature: GYAE6OF01AL09P.48.34.D01.1.454.CMB.1.raw
tcagagtatacatacacgaccggtgctcgatttagatcgtctgtgttgggttggggctgtgggctcaggaggcagagctctgggaatctcaccatggcctggacccctctcctgcctccccctcctcactttctcgcacagtctctgacggcctcctctgacgctgacacacgccctacccgtcggtcgtcgacgtccgtcccccgaaggaacaaaaccggccaaggactcctaccgtcgtacctcgtaggagtatgcctagttcgacctaaagttaaaatttttcgttagttacggtaacctaacgtgaacgttcgacggccaacggtcccctaggtcccgtgtactatttagcggaggaccacgacgcccggtaccctccgaacggtcctccccggtaggtaccgtacggttttcctacggtacggtaacgtaccgtaaccgtcggtaaacggggaccctttaacgggttccggtaacccccttaaccgtttacgtaaacccgttaccgttacccgtaccggggttaccggggggtaccccgtaagggggtacgggaacggttaacggtagggtaaacgggttacggttaaccgtttaaccgttttaccgtttacgttttacccgtaaccgttaaacccgtacgtaacccgtaaccgtaacggtaaccgtaacgtaaacgtacgttaacggtacgttaccgggtttacggttttaccggggaaccgggttaaaccgggtaccgtaaaccggtccggtaccgggtacccggttcccgggtaccgggttacccggaacccggtaccccggtaacgggccccgttacccgggttaccccccggttccggtacccgtaccccgtttccccgttccccggttaacccccccg

SEQ ID NO: 273974 - DNA, 736 bp, Homo sapiens
  misc_feature: GYAE6OF01CZ9IL.48.34.D01.1.454.CMB.1.raw
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctactttcgtccgccaggcctccgaggcgaaggggctggaggtgggtggcttgttgtgtacaaatgatggacatgctagaatangcagctcggtggacgggcctatcgctcnccagacactaatcaagacgtcgtacgtcatctagacaaatcggacgtccgcctaggacgtacctacggaacgacctacgggtcttagtacttaacgtttaccgtaggtacggacggtacgggacgggtccgtttaaccggtaaacgtttaaccgacccgggttaccgggtacgggggtaagtaacgtttaacgtttacgtttacggaaccgtaacgggtaccggggaacccgtaacgggtaaccccgttcggtacccgtaaccgttcccgtaccgtaccgtaccgtacccgtacccgaaccgaaccgggtacccgtacgtacccggttccccgttaccccgtcggtccccgtcccgtcgtacccgtacgaaccggacgacccgtaccgtaccggacgacgacccgaccggacggtcccggtcccggtcggtccgtcggtcccgtacggtaacctacggtacccttacgttacccg

SEQ ID NO: 273975 - DNA, 1107 bp, Homo sapiens
  misc_feature: GYAE6OF01EK0SW.48.34.D01.1.454.CMB.1.raw
tcagagtatacatacacgaccggtgctcgatttagatcgtctgtgttgggtgcagttggtggagtcggggggagtgtggtccagcctgggaagtccctgacactgtcctgcgcagcctctggattcaccttcaccacctttcgtatgctacttttgtcccgccgaggctccgaggcgaaggggctggagtgggtgcttgttgtgtacaaatgatggacatgctagaatatgcagtacctccggtggacgggccgtattccgcctttctccgagacgtaacctaacttacccaaaggacgtaccgtaccgggtttacaacgttccgttacgaacgtaaaacgttcggaacggtaccccggtccccgttacgggaaccggtaacccgtacgggaaacccggaaccgtaaccggggtacctttacggtttacctttaacggttttaaccgttcggttaccgggaacgggtaacggggtaaccggggttacccggtttaacccggttaaaacggtttttaaacccggacccggggttacccggggttaacggggggtaaacgggttaacgttttaaaccgtttttaaccggttttacgggtaaacccggtaaaccggggtttacccggggggaaccccgtaaacccggggggttaacccccgtttacggggtaaccccgttaacccccggtttacccgtttacccccggttacccgtaaccccggtacccccgttaaaccccccgggaaaccccggtaaaccccgggggtaccccccgtttaacccgggttttacccccggggtttacccccccgttttccccccccgggtaccgggggttacccccccggttccccccggtttaccggtacccccggtttaacccgggaacccgggggttacccccgtaacccccggttaacccccggttaaccccggaaaccgggtaacccggtaaccccggtaaaccccgggtacccgggggttaccccccggggtaccccgggtttacccggggggtacccgttaccccggggttccccggttaaccggggttaaaccccggtaaaaccgggtttaaccccgtttaaccccgtttttaaaccccggg

SEQ ID NO: 273976 - DNA, 650 bp, Homo sapiens
  misc_feature: GYAE6OF01AE8SY.48.34.D01.1.454.CMB.1.raw
tcagagtatacatacacgaccggtgctcgatttagatcgtctgtgttgggtgcagttggtggagtcgggggaggtgtggtccagcctgggaagtccctgacactgtcctgcgcagcctctggacttcacctttcaccctaccttttcgtatgctacttttgtccgccaggcctccgaggcgaagggctggagtgggtggtctgttgtgtacaaagtgagtggactagtgactagaatatgacacgaccgtcggtaggacgggtacctagttccgtccttccgtaccgagaacgactaacgttacgaagacgtccgtacggttcacgttctagaactaaagtcgacgcctaccgtagaacgccgtacgaccgacgacgtcttgttactagttacgtgtgacggtaggtacggtaccgttaaccgttaaggtttaaccggaccggtaccggttaggggaagttacttacgtttacgtacgacgtacggtacgggaccgtacggtaccgtcgtaccgtccgtcgtccacgccgtcctaccgaccgaccgccgtcgtcccgtcccgtccgcgccgtccgtcgccacgacgaccgccaccgtgcgcgccgacgacggccgtcgcgtcgccgtcgtcgacgtactccgtcgttacg

SEQ ID NO: 273977 - DNA, 938 bp, Homo sapiens
  misc_feature: GYAE6OF01CA4Z6.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctacttttgtccgccaggctccaggacaaggggctggagtgggtggctgttgtgtacaaatgatggacagtgctagaatatgcaacgaccgttccggtggacggggacctacgttccgtacctttcgtaccgaagaacgtaacgtaaaccgttaccgaaagacggtaccgtaacgggtttactaacgttcgtacgtaactaaaagtcggaacggtcccgtacccgttagggaaccgtaaccgtacgggaaaccgaaccgtaccgggtacttaggttaccttttaagttaccggttggttaccgggaacgggaacggggtaccgggttaccggtttaacccggttaaacggttttaaaccggtacccggggtacccggggttaagggggaacgggtttaacgtttaaaccgttttaacggtttaaccggaaacccggtaaccggggttacgggggtaacccccggtaaaccggggttaacccgttcgggttaaccccggttacccggttaccgtttaccccgtacccgtaaccccggttacccccgttaaccccgaaacccgggtaacccggggttcccctaacgggttaccccccgggtttacccccgtttaccccccgggtcgggtccccgtccggtttcccgtaccggttaccccgtaccggaacggtcccgtaaccctacccgggtacgaaccggtaccgacccggtaccgacccgggtccgggtacccggagggtcccttccggtaccgggttacggtaaccgttaaccggttccgttaaccccg

SEQ ID NO: 273978 - DNA, 822 bp, Homo sapiens
  misc_feature: GYAE6OF01E1RCR.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctacgttttcgtccgccaggcctccgaggcgaaggggctggagtgggtgcgttgttgtagtacaaagtgagtgacatgctagaatagtgacgacgaccgtcggtgggacgggtcctactccgtccttcgtaccgagaactaacctaacttaccgaaagacgaccgttaccgttactacgttacgtacgaacgtaacgtcggaccggtcccgtacccggttagaaccgtccgaacgaccgtaccgtaccggtactttcgttacttaacgtttacgtcggtacggagggaacggtaccgggtccgttaaccggtaacggtaacccggacgggtaccggtaggggtacgtaatttacgtttaacgtacgacggtaaccggcgggaaccgtaccggtacccgtcgtaccgcccgttcgtacccgaccgaccgtacccgaccgacccggtacggtccccttaaccgttcccggtcccccgttaccgggccccgtacccgtcccgttacggaccccgtacggtacccggtacccggaccctaaccgggtcccgaaacccggtagaaccccggtaccggttaccccggggacccgggtcccggtcccgggtacccggtcccgtaaccccgggtttacggtaaaccccgtacccggtttaacccttacccgggtttaaccc

SEQ ID NO: 273979 - DNA, 728 bp, Homo sapiens
  misc_feature: GYAE6OF01BAS83.48.34.D01.1.454.CMB.1.raw
  modified_base (248)..(248): a, c, t, g, unknown or other
  misc_feature (248)..(248): n is a, c, g, or t
tcagagtatacatacacgaccggtgctcgatttagatcgtctgtgttgggtgcagttggtggagtcgggggagtgtggtccagcctgggaagtccctgacactgtcctgccgcacgcctctggacttcaccttcacctaccttttcgtatgctactttcgtccgccaggcctccaggccaaggggctggagtgggtgctgttgtgtacaatgatggactatgctagaatagtgacagtacgttccggnggacgggcctattccgccttcgtacccgaggaacgtactaaatttcccgaagacgtccgtacggttacctaatccgtaggaacctaaaagttcggaacgcccgtcccgtagacgttacctaggaaccgacgtacggtctacggttctaacttcgtgacggaccggtaagggaccgggttccttaaccgggttaacgtttaaaccgcccgggtaccgggttaaggggaaggtttaacttacggtttacgttacggaaccgtaacggttcgggaccgaacggtaccgtgtaccgtacgtcctacgtcacgtcctaccacgaccgtctacgtcccgtcccgttcccgcggtccctacccgtgtacccttcggacccgtcgccgtaccggtcgtaccggactaaccgccggaccggtaccggtccccggtcggtccgtaccgtccgggttacgtaacccggacgttaaccgttcccggttcccc

SEQ ID NO: 273980 - DNA, 284 bp, Homo sapiens
  misc_feature: GYAE6OF01BUXEM.48.34.D01.1.454.CMB.1.raw
  modified_base (255)..(255): a, c, t, g, unknown or other
  misc_feature (255)..(255): n is a, c, g, or t
  modified_base (257)..(284): a, c, t, g, unknown or other
  misc_feature (257)..(284): n is a, c, g, or t
tcagagtatacatacacgaccggtgctcgatttagatcgtctgtgttgggtttggggggtgtggtggtctccactcccgccttgaagaggctgattactactgtcagtcttttgataaacaaacaatcacgtggtcttcggcggaggaccagcctgaccgtcctaggtcagcccaaggctcgccccctcggtcactctcttccccaccctcctctatgtatactctgagcgggctgggacaaaggcgcaagtagnannnnnnnnnnnnnnnnnnnnnnnnnnnn

SEQ ID NO: 273981 - DNA, 770 bp, Homo sapiens
  misc_feature: GYAE6OF01DSZTN.48.34.D01.1.454.CMB.1.raw
  modified_base (397)..(397): a, c, t, g, unknown or other
  misc_feature (397)..(397): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctactttcgtccgccaggtctccgaggcgaaggggctgggaggtcgggtggtctgttgtgtacaaatgatggactatgactagaatgtgacacgtacctccggtaggacgggtcctattccgtccttacctaccgagtacgtaacctaacgttaccgaaggacgtacgtacggttcaacgttctagactaaacgcgacgcccgtacctaggacaccgtagacaccgtagtccgtgtacttattaccgnggtcgaggtacggtacgggtccttaccgtaagttaccgacgggtccggtaggggtaagtacttaacgtttacgttacggaaccgtacggtccggggacccgtaacgggtaccccgtggttaccccgtaccgttcccgttaccgacccgtaccgtcccctaaccccggaacccgggttacccggccctttacggttacccccgggtcccccgtttaccgtccgggacccttaccccggtcgaccccgttacggacgggtaccccaccgtaccccgtacggaaccgtacgaccgtccgggcccgtacccgggtcccggtgtaccccggacggttacccgtaggtaaccccgtaaacggttcccttaccgttaacg

SEQ ID NO: 273982 - DNA, 865 bp, Homo sapiens
  misc_feature: GYAE6OF01BTZFM.48.34.D01.1.454.CMB.1.raw
  modified_base (184)..(184): a, c, t, g, unknown or other
  misc_feature (184)..(184): n is a, c, g, or t
  modified_base (237)..(237): a, c, t, g, unknown or other
  misc_feature (237)..(237): n is a, c, g, or t
tcagagtatacatacacgaccggtgctcgatttagatcgtctgtgttgggtttgggggtgggctcaggaggcagagctctgggaatctcaccatggcctggacccctctcctgcctccccctcctcactttctgcacagtctctgacggcctcctctgacgctgacacacgcccacccgtggtntccagtcgtaccccaggaccaaacggccgaggactccacctgcctcgtagganagtcgctagttcgacctaaaggtttaaattttgtaacgttacggtaacctaacgttggaaacgtcgacggaccaccggtccctacgtcccgtaggttaccttaatttacggaggaccgggtaaccaaccggacggacccgtaacccctacgtacgggtacctcccggtacggtaccggttacgtttacctgtacgggtactaccggaactacggtaacgggacttacgttacccgggtaccctaccggttacgtaaccgtaaccgttaccggtacccgggtacgggggtaccccgtaaggggggttaggtaacggggttaaacggttaacggggtaacgggtttacggttaaacccgtttaacccgtttacggtttacgtttacccgtaaccgtaaaccgtaacggtaaccctaaccggtacgtaacggtaacctacgtaacgtacgtacggttacggttacgggttttaccgggaaccgggtaaccgggaaccgtacggtacccgttacggtaacccgttcgggtaccggtacgtacccgtacccgggacggtcccgtacccggttaccccggtaccggttacccgttaccgttaccccgttcccggttcccccgtcccgttacccg

SEQ ID NO: 273983 - DNA, 253 bp, Homo sapiens
  misc_feature: GYAE6OF01B7CQA.48.34.D01.1.454.CMB.1.raw
  modified_base (243)..(243): a, c, t, g, unknown or other
  misc_feature (243)..(243): n is a, c, g, or t
  modified_base (248)..(253): a, c, t, g, unknown or other
  misc_feature (248)..(253): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctcgccccctggtcactctcgttccccgccctcctctatgtatactctgagcgggctggcaaggcgnatagnnnnnn

SEQ ID NO: 273984 - DNA, 674 bp, Homo sapiens
  misc_feature: GYAE6OF01AQ7JY.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtgctgttgtgtcaaatgatggacatgctgaatatgcagactccgtggaggggccgtattccgccttctccgagagacaattccaagacgcacggttcatctgacaaatgagccgccctgagacctgacgacacggctgtctattactgtgcgaggacgggtcgtccggtaagtttaaccacggtccggtcggggaaggtaattagttaaccgttttgaacgtaacgtcggggaccgaacggggtaacccctgggtacccgaccgttcccgtcccgtacgacgtccccttacccgaaccggtaacgggccccctagttaccccggtcccttacccccgtcgggccccgtcccgttcgccgttacccgacgggaccgcctaacccggtccgaaccgtcggaccctaccgaaccgggtccgggtccccgtacggggtcctacccgggtcccttacggggtaccaacgggttcccttacccgtttacccg

SEQ ID NO: 273985 - DNA, 914 bp, Homo sapiens
  misc_feature: GYAE6OF01AP8DJ.48.34.D01.1.454.CMB.1.raw
  modified_base (376)..(376): a, c, t, g, unknown or other
  misc_feature (376)..(376): n is a, c, g, or t
tcagagtatacatacacgaccggtgctcgatttagatcgtctgtgttggtgcagttggtggagtcgggggaggtgtggtccagcctgggaagtccctgacactgtcctgcgcagcctctggattcaccttcacctacctttcgtatgctacttttgtcccgccaggcctccgaggcaaggggtctggaggtgggtggcttgttgtgtacaaaatgagtggacagttgcttagaatatgactacgacgtccggtaggacgggtacctattccgtccttcgtcccagaacgaacaacttaccgaagtacgccgtaacggtctagtcctagaactaagtcgacgtcctacccggtagaccgtaccgacgaccggtaacnccggtcttacgttaccttaacgttcgtaggttacgaccgggtaagggaccgggtttacccgttaacggtaacgtttaacccggcccggggtaccccgggttaacgggggtaacggtttaatttaaacccgttttacggtttaacgtaaccccgggttaacccggggttaccgggggtaacccccgtaaccgggggttaacccccgtttcgggtaacccccgttacccggtaccccgttttaccccgacccggtaacccggttacccccctaaaccccggtaaaccccggtaacccggggtaccccctttacccggttaccccccgggtttccccccgtttaccccccgggttcggggcccccccgttacccggtacccgttcccgttaaccccgggacgggtacccctaacccgtaccccggtaccggacccggtaacacccgacccggttacccgggccccgggtcccgtacgggttccccttacgggtacccccgtaggttaaccccgaaacggtttcccgttacgtttaccccgg

SEQ ID NO: 273986 - DNA, 828 bp, Homo sapiens
  misc_feature: GYAE6OF01BMIRM.48.34.D01.1.454.CMB.1.raw
  modified_base (245)..(245): a, c, t, g, unknown or other
  misc_feature (245)..(245): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctactttgtccgccaggcctccgaggcgaaggggctgggaggtggggtcggcgttggttgtgtactaaagtgagtggacatgtactagtaattagngacgaggaccgttcggagggtacgggggtaccgtacgtttccgttacccttccgaccgaaggaacgtaaccgtaaacttacccggaaagtacggaccgttaacggttctaactaccgtagaactaaagtggtaccgtccgtacccgtcggaaccgtccgtaaggaccgaccggacggttcgttacgttactttacgtacgttggtaccggtaggacggggtacggtcccggttaacgttaacgttaaccggccgggtaccgggtacggggtaagttacgtttacgtttaaccgttacgggaaccggtaaccgggtacggggaccgtaccggggttaacccgttcggtaaccctaccggtccttacccgacgtccctaccccgaacccgtaacccggccggtaacccgttacccgtccgtttacccccttcccggtacggtcccccgtacccggttacgtccaacccggacggacccgtacccgtacccggtacgacggtacccgaccgacggtaccccgggcccgtaccgggtgtcccgccggttccgttaccgggaaaccgtcgttaccgtttagtaacccg

SEQ ID NO: 273987 - DNA, 890 bp, Homo sapiens
  misc_feature: GYAE6OF01EU5S0.48.34.D01.1.454.CMB.1.raw
  modified_base (168)..(168): a, c, t, g, unknown or other
  misc_feature (168)..(168): n is a, c, g, or t
tcagagtatacatacacgaccggtgctcgatttagatcgtctgtgttgggtgcagttgggtggaggtcgggggggaggtgtggtccagcctgggaagtccctgacactgtcctgcgcagcctctggattcaccttcacctacctttcgtatcgctactttcgtccgcnggcctccaggcaagggctgggaggttgggtgctgttgtgtacaaatgagtgactatgcgtagaatatcgacgtagaccgttcggtagggacggggtccgtacgttccgtaccttcctaccgtaacggaacgtaactaacttaaccgaaggaacggtaccgtacggttactacttcgtacgtaacctaaagtacggacgcgtcccgtacggtacgaccgtaccggaaccggtacccggtacggtaccgtacgttacgttaaccgttacgttacggtcggtaacggaaggggttaaccgggtaccccgggttacggtttaaacggtttaaacccggtaacccggttacccgggggttaacgggggttaaggggtaacttttaaccgttttaacgggttaaccttaacgggtaacccggtacggggtacccgggtaaacccggttaccgggttaacccgttaccggtacccgttacccgtttaccgtacccggtacccggttaccccgtaacccgtaaaccccgggaaccccgttacccgggtacccgtacccggtttccccccggttacccggtcccccggtacccggtacccggtacccgtaccggtaccccggtaccggaccgtacccgtacccgtacccggtaccgacccgtaccgtacggacccggccggccggtccggacggtacccgtcggtaccgtaccggtacgttaccggtaccc

SEQ ID NO: 273988 - DNA, 777 bp, Homo sapiens
  misc_feature: GYAE6OF01COIZ7.48.34.D01.1.454.CMB.1.raw
  modified_base (112)..(112): a, c, t, g, unknown or other
  misc_feature (112)..(112): n is a, c, g, or t
  modified_base (194)..(194): a, c, t, g, unknown or other
  misc_feature (194)..(194): n is a, c, g, or t
tcagagtatacatacacgaccggtgctcgatttagatcgtctgtgttgggtgcagttggtggagtcgggggagtgtggtccagcctgggaagtccctgacactgtcctgcgnagcctctggattcaccttcaccacctttcgatgctactttgtccgcaggctccaggcaaggggctggagtgggtgctgttgngtacaaatgatggactagtgctagaatatgcagactcgtaggagggccattccgccttctccgaggactactaagttccaaaggcgactacggttacactacgtacgaacgaaagttcggaacgtacccgtaccccgtaggacgtacccgtaggtaaccgtaaccggtaccggtaccgttacggtactttaaacggttccgttcggtaacgacgggtaaggtccggggttaacctaccgggtttaaagtttaacccgaaccgggttccccgggtaaagggggtaacgtttaacgtttaacgttaaccgtttagtaacccggttaacggtccgggggtaaccgtacgggtaccccgttaggtacccgtaacgtcccttacgtccgtaccgtacccgttacccgaaccgtaacgggtcccctacggtcccgttacccgttaacccccggtcggtacccgttacccctggtaccccttacggacgttacccgacccgttaccgtaccgacggtaccgacgtaccggacgtacccgggtacctcgggacctggtacccctagggtaccaaggtcccgttacgtaccg

SEQ ID NO: 273989 - DNA, 296 bp, Homo sapiens
  misc_feature: GYAE6OF01CBFEE.48.34.D01.1.454.CMB.1.raw
  modified_base (267)..(296): a, c, t, g, unknown or other
  misc_feature (267)..(296): n is a, c, g, or t
tcagagtatacatacacgaccggtgctcgatttagatcgtctgtgttgggtttggagggtgtggtggtctccactcccgccttgacgaggctgattactactgtcagttcttttgataacaacaatcacgtggtcttcgggcggagggaccagcctgaccgtcctaggtcacgcccaaggcctcgccccctggtccactcctcgttccccaccctctctatgtactactcgtggacggcgggtctgggacgaaggcctataagtagnnnnnnnnnnnnnnnnnnnnnnnnnnnnnn

SEQ ID NO: 273990 - DNA, 615 bp, Homo sapiens
  misc_feature: GYAE6OF01CSUU1.48.34.D01.1.454.CMB.1.raw
  modified_base (116)..(116): a, c, t, g, unknown or other
  misc_feature (116)..(116): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
  modified_base (499)..(499): a, c, t, g, unknown or other
  misc_feature (499)..(499): n is a, c, g, or t
tcagagtatacatacacgaccggtgctcgatttagatcgtctgtgttgggtgcagttggtggagtcggggggaggtgtggtccagcctgggaagtccctgacactgtcctgcgcancctctggattcaccttcacccacctttcgtatgcacttttgtcccgccaggctccaggcaaggggctggagtgggtggctgttgtgtcaaatgatggacatgctgatatgcagactcgtggagggccattcgcctttctccagacgacaacttccaagacgcgtacggttacattcngacaaatgacgccgtaccctgacgtacctggaacacgacgtctacgtacttacgttacnggtagcggaaggacgggtcgtaccgtaagtttaaccgaccggcgggtagggaaggttattagttacttgaacgtacgtcgggacacggtacccngtccacgtcnccgtcacgtccaccgacgaacggcctacgtccgttcctcccgngcccgtaccctgcctacggaggccaccgtacccgtaccaggtacacccgtaacgcccggtcccgggccgtcggtccctcggtcccgttagggtacaaccgggtccttcggttaccc

SEQ ID NO: 273991 - DNA, 263 bp, Homo sapiens
  misc_feature: GYAE6OF01EVULH.48.34.D01.1.454.CMB.1.raw
  modified_base (247)..(263): a, c, t, g, unknown or other
  misc_feature (247)..(263): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnnnnnnnnnnnnnnnn

SEQ ID NO: 273992 - DNA, 793 bp, Homo sapiens
  misc_feature: GYAE6OF01EFU09.48.34.D01.1.454.CMB.1.raw
  modified_base (377)..(377): a, c, t, g, unknown or other
  misc_feature (377)..(377): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtgctgttgtgtcaaatgatggacatgctgaatatgcagactccgtggacggggccgattcgcctttctccaagagacaattccaagacgcacggttcatctgacaaatgagccgccctgacgacctgacgacacggcttcgtactagttactgtcgcggaggacgggtccgtccgtaaggtttaaccncggtacccgggtaggggaggtacttaagtttaccgtttgaaccgtaacggttcggggaccgtaacggggtaaaccccttgggtacccaacccggttcctcccgtacgtaccgaccccttaccccgaaccgtaacccggggtcccctaacgtttccccggggttccccttttcccccccgggtacggggtcccccgtccccggtttaccggtaccccgttaccccgggtaacggggaccccgtaccccgtaacccccgttacccgggaacggtaaaccccggtccgtaaacccgggtaaccgggtccccgggtaacccccgggtttccgggggacccgtttacccgggtaccccggtttaccggggttaaacccggtaaacccgggtttaaccccgtttaccccgttttaaccccgg

SEQ ID NO: 273993 - DNA, 960 bp, Homo sapiens
  misc_feature: GYAE6OF01BF52P.48.34.D01.1.454.CMB.1.raw
tcagagtatacatacacgaccggtgctcgatttagatcgtctgtgttgggtgcagttggtggaggtcggggggaggtggtggtccagccgtgggaacgtccctgacactgtcctgcgcagcctctggattccaccttcaccctacctttcgtatgctactttcgtcccgccgacggcctccgaggacgaaggggcgtgggaggtgggtgtcgttgtttgtgtactaaagtggagtaggactagtgtactagtaatagtcgacaccggtaccggtccggtagggacggggtacccgtacgttccgtccctttccgtaccgaacgtaacggtaaacctaaacgttaaccgaaacggacgtaccggttaaccggttacctacgttacgtacgaactaaaggaccggaccggtcccggcccgtacgaaccgtaccgtaacggaaccgacggtccgttacgttacgttacttacgttccgtaggtacgacgggacgggtacggtacccgttaacggttaacggttaacccgtacggggtacggtacgggtaacgttagttaacgttacgttaacggaccgtaacgggtaccgggtaccggtaaccggttacccggtacggttaacccgtcccgttaccctaccggtaccctacccggaccccctaaccgtaaacccgtacccggtcccgttacccggttcccccggttacccccggtttccccggacccggttacccccggccccgtttacccggtacccggttaacccgggacccggtaaccccgtccccgtaacccgtacccggggtaacccgaaccccggtaccggtacccgggtccccccggggttaccccgggtacccgggttccccgggaccgggttaccccccgggttaccggggttaacccggtttaacccccgggaaacccggttttaacccccgtttcccccgttttacccccgg

SEQ ID NO: 273994 - DNA, 730 bp, Homo sapiens
  misc_feature: GYAE6OF01CFPU7.48.34.D01.1.454.CMB.1.raw
  modified_base (270)..(270): a, c, t, g, unknown or other
  misc_feature (270)..(270): n is a, c, g, or t
  modified_base (669)..(669): a, c, t, g, unknown or other
  misc_feature (669)..(669): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtacaaatgatggacatgctagaatatgcagactccgtgagggccattccgcctctcagagacaatccaagngctacggtcatctagacaaatgacgcccgtccctaggaacgaccgtacggaaccgaaccgtacgggtcttcggttaaccttaagtttacctggtacggacggaaagggtcgggtacccgtaaccgtaacgttttaaaccgaccgggtacccgggtaggggaaggtattttaacgttacgtttcgaaccgaacggtacggggacccaacggggtaacccccgtggtacccgtaacccgttcctacccctaccgtacccggtaccctaccccgaacccggaaacccgggccccgtaacgttccccccgggttacccgttcccccccgttcgggccccgtccccgtctccccggtaccgaacggacgtaccccgacccgtaccggacgaccgaccggaaccncgggtcccggcccgtgggccctcggaccgttcggaaccgaaacgttcgttaacccttccgg

SEQ ID NO: 273995 - DNA, 739 bp, Homo sapiens
  misc_feature: GYAE6OF01E0285.48.34.D01.1.454.CMB.1.raw
  modified_base (107)..(107): a, c, t, g, unknown or other
  misc_feature (107)..(107): n is a, c, g, or t
  modified_base (207)..(207): a, c, t, g, unknown or other
  misc_feature (207)..(207): n is a, c, g, or t
tcagagtatacatacacgaccggtgctcgatttagatcgtctgtgttgggtttgggggcagaagtctctctcagtccagacacagcatggacatgacgggcccccgntcagctcctgggactcctgctgctctggcctcccagactaccagatgtgacatccagatcgacccagtctccatccctcctgtctgcatcgtggtggganacaggacgtccaacggtcacgttcgggccgggacgagtcgagggtctaatttaaactaatttaacgtttacgccgttaggttactcacgccagcctaagtacccgaaggggtaaacctttaccgtaaacggtccttaccgtagtacttaccgttagtcgtacgtacgtaccttacttacccttacgtttacgaaccgtaaacgtccgggtaaccggggttacccctagttacccggtttcgggttacgtacgggttcggggtcggttaggtaacgttacgggtacgggtaacgtacgtacgtttaccacgttcctacctaccgactacgacgcctacgcctgacgtacgactaggaagtagtgttacgacttaacgtttacttaacgtacgttaacgtaaacgttcttaccttaccgtttacccgaaccccgttacgttaccccgtaccggtttacccggaacggtaaaccgggtacctaaaccgggtacgtaacgggtaaacttaaacccggttaaacgtacggtaccggg

SEQ ID NO: 273996 - DNA, 832 bp, Homo sapiens
  misc_feature: GYAE6OF01EEVX9.48.34.D01.1.454.CMB.1.raw
  modified_base (186)..(186): a, c, t, g, unknown or other
  misc_feature (186)..(186): n is a, c, g, or t
  modified_base (230)..(230): a, c, t, g, unknown or other
  misc_feature (230)..(230): n is a, c, g, or t
tcagagtatacatacacgaccggtgctcgatttagatcgtctgtgttgggtttgggggtgggctcaggaggcagagctctgggaatctcaccatggcctggaccccctctcctgcctccccctcctcacttttctgcacagtctctgacggtcctcctctgagctagacacacgccacccgtggtntcaggtctcccgaggacaacggccaggactccactgctgtggantgctattcgactaaagttaaattttgttatacggtaccaatagtaagtcgacggcctacggtccctggttcgttgtccacgtttccggagaaacgtactaaacgaaccggccgtaccctacgagggacctaccgtacccgtaggacgtcggttaactttcgtccgtacggtcccttaacccgaacgttccgggtaacggtaaaccctccggtacccgaaccccttaccccgtacgaaccctaaacggtacccgggtaacccgggggaacccgtacgggttccgtaacgggaacgttacgggtaaccggttacggttaacgttaacttaaccgttaccgtaacgggtttccggtagggtaaccgggtaccggggttaacggaacgtaacggacccgtaaccgtacgtaccgggtacgggttaaccggggtttcccggggggaaccggggttaccgccgggtaccggttacccggacccggggtcgggttacccgggtacccgaccgggtaccccggttaacggcccggttccccggaccccgggttccttacccgttacccgttcccggttaccccgttcccccgttcccgtccttaacccgg

SEQ ID NO: 273997 - DNA, 591 bp, Homo sapiens
  misc_feature: GYAE6OF01E0ETK.48.34.D01.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (368)..(368): a, c, t, g, unknown or other
  misc_feature (368)..(368): n is a, c, g, or t
  modified_base (466)..(466): a, c, t, g, unknown or other
  misc_feature (466)..(466): n is a, c, g, or t
tcagagtatacatacacgaccggtgctcgatttagatcgtctgtgttgggtgcagttggtggagtcggggggaggtgtggtccagcctgggagtccctgacactgtcctgcgcagcctctggattcaccttcaccacctttcgtatgcacttttgtccgccaggctccaggcaaggggctggagtgggtggctgttgngtcaaatgatggacatgctgaatntgcagactccgtgagggccattcgccttcnccagagacaattccaagagcacggttcatctcgacaaatcgagccgccctgacgacctggacacacggntgtctatacngtgcgngaggcgtcgtaagttacacggccggtagggnggtattattacgttgacgacgtgggccacgggaccctgtccacgtctcccgtcacgtccctaccgacccgaacggcccacgtccggtccttcccccgnggcccgtcccgtacgtccctccgacggaccgcccgaacctccggaagacgccgaccgtacggcccggtaccccgtgggcccgtcggtccgtacgggtaccaaccggttaccgttacccgttaccg

SEQ ID NO: 273998 - DNA, 833 bp, Homo sapiens
  misc_feature: GYAE6OF01DPS6S.48.34.D01.1.454.CMB.1.raw
tcagagtatacatacacgaccggtgctcgatttagatcgtctgtgttgggtgcagttggtggaggtcggggggaggtgtggtccagccgtgggaagtccctgacactgtcctgcgcacgcctcgtaggtacttcctacccttccaacccttaccgtttcgtatcgtccttacgtttcgcccgaccgacggcctccgagggaccgaaggggcgtgggaggtggggtgtcgttggttgtagtacaaagtgagtggactagtcggctaagtaatcgtcgacgaacgtccgttccgggaggggaccgggtccgtactttcccggtacctttaccgaccgaaggaactaaccgttaaacgtaccgaaaggtccgtaccgttacggttactacgttacggtacaaacgtacgtaccgaccgacccgtaccgttacggaaccggtacccgtacggaaacgtacccggtcggttaccttacgttaacgttacgtttacggcggtacggacgggaacgggtccggtaccgttacggtaacgtacggacggcgggtaaggtattactttagttacgtacggtacgtaccgggtacggtaccgggaaccggttaccgtacgtacccgtaccgtcctaccgaccgacctacccgtacccggaaccggacccggtcctccggttcccgtcccgtcccggacgtcccgccgtccgaccgtaccggtacgacccgtacccggtaccgaccgtacgaaccgccgaacccgggtccggacccggtccccgggtgtacccggtccggtacccggtaacgtaaaccgggtaccttacggtttcccgttaacg

SEQ ID NO: 273999 - DNA, 275 bp, Homo sapiens
  misc_feature: GYAE6OF01C3B81.48.34.D01.1.454.CMB.1.raw
  modified_base (244)..(244): a, c, t, g, unknown or other
  misc_feature (244)..(244): n is a, c, g, or t
  modified_base (250)..(275): a, c, t, g, unknown or other
  misc_feature (250)..(275): n is a, c, g, or t
tcagagtatacatacacgaccggtgctcgatttagatcgtctgtgttgggtttggggggtgtggtggtctccactcccgccttgacgaggctgattactactgtcagtcttttgataaacaacaatcacgtggtcttcggcggaggacagcctgaccgtcctaggtcagcccaaggctcgcccccctggtcactctcgttcccaccctcctctatgtatactctgagcgggctggacaaggcgntatagnnnnnnnnnnnnnnnnnnnnnnnnnn

SEQ ID NO: 274000 - DNA, 826 bp, Homo sapiens
  misc_feature: GYAE6OF01EHLLA.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgcactttgtccgccaggctccaggcgaaggggctggaggtgggtgctgttgtgtacaaatgatggacatgctgaatatgacagacctccggtgggacggggtccgtacttccgccctttcgtaccgaagtaacgtaacctaactttaccgaaaagtcgaaccgtaccggtttacgaacttaccgaggtacctaaaaggtcggaacgtcccggtccccgttagggaacgtacccgtaggtaaccgaaccgtaccgggacctttcgttaccttaacggttcgttaggtacggcggaaagggtccggggtaccttaaccggttaaacggtttaacccgcgggtaccggggtacggggaaggttactttaactttacggttacgtaaccgtaacggtaccggggaccgtacgggtaacccgttcggtaccgtacccgttccgtacccgtaccaccggtccccgttacccgaaccggtaacccgggtacctaaccggttccccgttacccgttcccccggtcgggtccccgtcccgttcccgtaccgtacccggtacggtacccgcccgtaaccggtacccggacggtaccgaaccgccggtaccggccccggtcccggtcgggtacccgttccggtacccgttccggtaacccgtaacgggttccccttaacggtttacccg

SEQ ID NO: 274001 - DNA, 754 bp, Homo sapiens
  misc_feature: GYAE6OF01AJJS6.48.34.D01.1.454.CMB.1.raw
  modified_base (675)..(675): a, c, t, g, unknown or other
  misc_feature (675)..(675): n is a, c, g, or t
  modified_base (736)..(736): a, c, t, g, unknown or other
  misc_feature (736)..(736): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgactactttgtccgccaggctccaggcaagggctggagtgggtggctgttgtgtacaaatgatggacatgctagaatatgcagccgtccggtggacggggtcctattccgtccttcctccgaagacgtactaactaccgaaggcgtaccgtacggttctaacttcgtacgaaccgtaaacgtcggaccgtcccgtacccgtaggaaccgtaccgtacggaccgaccgtaaccggtcttacggttaacttacgttcgtggtacggcggtaagggccggtacgttaccgttaacggttaccgaccgggttccggtacggggtaagtacgttttaacgtttacgttacggaacccgtacgggtaccgggaccgtaacccgggttaccgttacccggtccgtaccggtaccttccgaccgtacgtcccgtaacccgacgggtaacccggcccgttaccggtcccggttcccccttacccgggcggtccccgtccgttacgccgtaaccggtaacggcccgaccgttacccncggtaccgaccgaccgtaccggacggttcccggccgtaccgtcgtaccgtcggtacgtacnccgttaaccgtccgtccg

SEQ ID NO: 274002 - DNA, 664 bp, Homo sapiens
  misc_feature: GYAE6OF01D7SQ2.48.34.D01.1.454.CMB.1.raw
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
tcagagtatacatacacgaccggtgctcgatttagatcgtctgtgttgggtttgggggtgggctcaggaggcagagctctgggaatctcaccatggcctggacccctctcctgcctccccctcctcactttctgcacagtctctgaggcctcctctgagctgacacagccaccctcggtgtcagtcgtcccaggacaacggccaggatcacctgctcnggagntgcattgacaagtaaattttgtataggtaccaactgagtcaggccaggccctgtcctggtcatttagtgaggaccgtaacgacgacgaccctccaaggactcctggcgtacggttctcgtgacgtacgtaacgtcgaagggtactacgttcggccctaccttacgactactcgacgtcggggacccgagggtagggtaggactaggaaggttcgacgtttacttctcgttttacctactaaacacgacctacgtacgtaggactaatcaagtacggtacgtaacgttttacgggaccgggtaacgggaaccgaacgtaccgtaccgttacccggtacccgttacgggtaccgtaccggtacccggaacggtcccgtcccgtacccccgttaccgggtacccttaccgttccccgttccgttaccccgtaccccgttacccg

SEQ ID NO: 274003 - DNA, 275 bp, Homo sapiens
  misc_feature: GYAE6OF01C4BIA.48.34.D01.1.454.CMB.1.raw
  modified_base (209)..(209): a, c, t, g, unknown or other
  misc_feature (209)..(209): n is a, c, g, or t
  modified_base (259)..(275): a, c, t, g, unknown or other
  misc_feature (259)..(275): n is a, c, g, or t
tcagagtatacatacacgaccggtgctcgatttagatcgtctgtgttgggtttggggggtgtggtggtctccactcccgccttgacgaggctgattactactgtcagtcttttgaataacaacaatcacgtggtcttcggcggaggaccagcctgaccgtcctaggtcacgacccgaaggctcgcccccgtcggtcactcgtcgtcccnccctctctatgtactactctggaggcggctggacgaaggctacaagtagnnnnnnnnnnnnnnnnn

SEQ ID NO: 274004 - DNA, 862 bp, Homo sapiens
  misc_feature: GYAE6OF01D0Z5W.48.34.D01.1.454.CMB.1.raw
  modified_base (245)..(245): a, c, t, g, unknown or other
  misc_feature (245)..(245): n is a, c, g, or t
tcagagtatacatacacgaccggtgctcgatttagatcgtctgtgttgggtgcagttggtggaggtcggggggaggtgtggtccagcctgggaagtccctgacactgtcctgcgcagcctctggattcaccttcacctacctttcgtatgctacttttcgcccgccaggcctaccgaggacgaagggggctgggaggttgggtgcgttgtttgtgtacaaatgaagtggacagtgactagaattntggacagtaccgttccggtgggaccggggcctacgttccgtaccttttcaccgaagaacgtaacctaacgttacccgaaagccgtacgtaacggtttcatccgtagaactaaagtcggacgcccgtaccgtaggaaccgtaccgtcgaaccgaccgtacggtcttacggtacttacgttcgaggtgaacggacggtacgggtccgttaacggttaaacgtttaaccggcccgggcggggtttaacggggaacgtaactttaactttacggttaaccggacggttaaccgggccggggtaacccgaacgggttaccccgttacggtacccgtacccggttcccgtcccgtaccgtaccggtacccctaacccgaaacccggtaaccgggtccccgttaaccggttccccggttaccccgttcccccggacggtccccgtcccggtacgtacccttacccgggaaccggtcccgaaccccgttacccgggtaccggaaccggtacccggtaaccacccgggtccccgggtacccgggtccccgggtacgggccgttacccgggtacccgtttaacggggaacccggttaaacccgttcccgtttaaaccgttaacccgg

SEQ ID NO: 274005 - DNA, 1021 bp, Homo sapiens
  misc_feature: GYAE6OF01B2VCZ.48.34.D01.1.454.CMB.1.raw
tcagagtatacatacacgaccggtgctcgatttagatcgtctgtgttgggtttgggggtgggctcaggaggcagagctctgggaatctcaccatggcctggacccctctcctgcctccccctcctcactttctgcacagtctctggacgccctccttcgtaggacgcgtacgaaccactaccgaccccaaccccggttcgggttacgtccgtaacggttccgtacccccccgaaagggaaacccgtaaaaacccggggccgtaaacgggtaccttacctaacccgttcggcctttccggtagggagacgttacgtaccttaacgtttaccggaaaccgttaaaaaggtttttaaaagtttttttaggtttaaacggttttacccggggttaaaccctaaacggttacggtaaacggttaaccggaccgggacccccgtaacccgggttccccccgttacggtttaccccggtagggttaccctttaatttaacggttacggggaaaccgggaaccccggtaaccccgtaaccgggacccccgttaaccccccggttaacccggtaacgggtacccccggttaaccccccgttcgggtaacccgggtttaacgggtttccccgttaacccgggttaggtaaccggttacccggttaaaccgtaacgggtaaccgggaaccgtttacggtttaccccgggtaccccgttaaccgtttaccgtaaaccgtaccttacccgggttaaacccgggtacccgggggaccccgggttaaagggggtacgggtaacgggtaaggttacggggtaaacgggttcgttaacccgtttaccgttttacgttaccggtttacccgtaacgtaacgtaacgtaacccgtacgtaacgacgtaactacgtactacgtaggtaccgttacgggttccggacgggaacgaacgtcgacgttcgtacgtccggtacgacgaccgacgtcggcctcccggtccctacgtacccacgttaccctccgtcccgtcctaccg

SEQ ID NO: 274006 - DNA, 279 bp, Homo sapiens
  misc_feature: GYAE6OF01B6BIA.48.34.D01.1.454.CMB.1.raw
  modified_base (246)..(246): a, c, t, g, unknown or other
  misc_feature (246)..(246): n is a, c, g, or t
  modified_base (252)..(279): a, c, t, g, unknown or other
  misc_feature (252)..(279): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatccacgtggtcttcggcggagggaccagcctgaccgtcctaggtcagcccaaggctcgccccctggtcactctcgttccccgccctcctctatgtatactctggacgcggctgggacaaggcncaatgnnnnnnnnnnnnnnnnnnnnnnnnnnnn

SEQ ID NO: 274007 - DNA, 728 bp, Homo sapiens
  misc_feature: GYAE6OF01BWQAK.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccaccttttcgtatgcacttttgtcccgccaggcctccaggcgaagggggctggagtgggtggctgttgtgtacaaatgatggacatgctgaatagtgcagacctccggtgaggggaccgattccgccttcctccagagaacaacttccaaggacgctacggttcatctgacaaatggacgccgtcccgtgaacgaccgtacgaccgacgaccggtcttagtacttatttacgtgtcgtacggacggacgggtccgtaccggttaacgtttaaccgccgggtaccggtacggggtaggtaatttactttaacgtttacgaaccgaacgggttcggggaccgaacgggtacccgtggtacctacccggtacctcccgtactaccgtcccgtacccgaaccggaccgggtacccctaggtttccccgttacccgttcccccgtccgggcccgttccccgtccgtccgttcccggaacggtcccgtacccgaccggttacccgaggtacccgaccggtaccgaccggccccgggtccccgttcgggcccgtccggttaccggtacggtaaccaaccggtccctttacccgttaaccg

SEQ ID NO: 274008 - DNA, 812 bp, Homo sapiens
  misc_feature: GYAE6OF01BBH8Y.48.34.D01.1.454.CMB.1.raw
tcagagtatacatacacgaccggtgctcgatttagatcgtctgtgttgggtgcagttggtggagtcgggggaggtgtggtccagcctgggaacgtccctgacactgtcctgcgcagcctctggattcaccttcaccacctttcgatgcactttgtccgccaggctccgaggcaaggggctggagtgggtgctgttgtgtcaaatgagtggacagtcgctagaatactgcacgtaccgtccggtggacggggtcctattccgtccttctacccgaggaacgtacctaacttaccgaaacgtacgtaccgtacggttccacgtctacggactaaagtcggacgtcccgtacccgttgaacgtaccgtacggaaccgtaccgtacggtcttacgttaccgttaacgtttacggtggtaccggacggtacggggaaccgggtcccgtttaaccggtaacggttttaaacccggccgggtacccgggtacggggtaacggttaactttaaccggttttaaccgttacggaaccgtaaccgggttacggggacccgtaaaccggggtacccttcgggtaacccctaccggttccttaccgtaccgaccgttccccgtacccgtaaccggaaccgggtcccccttaggttacccccgggttccctttacccccggcgggtaccccgttcccgtacgtacccgtaacggtacgaccggtccctaacccgtccggtaagacccgacgtacccggaccggtcccggtcccgtagggccccttacgggtcccttacgggtaccaacggttcctttaaccgtcg

SEQ ID NO: 274009 - DNA, 337 bp, Homo sapiens
  misc_feature: GYAE6OF01E1C2R.48.34.D01.1.454.CMB.1.raw
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (275)..(276): a, c, t, g, unknown or other
  misc_feature (275)..(276): n is a, c, g, or t
  modified_base (284)..(337): a, c, t, g, unknown or other
  misc_feature (284)..(337): n is a, c, g, or t
tcagagtatacatacacgaccggtgctcgatttagatcgtctgtggttgggtttggggggtgtggtggtctccactccgccttgacgaggctgattactactgtcagtcttttgataacaacaatcacgtggtcttcggcggagggaccagcctgaccgtcctaaggttcagtccccaaaggctacgcccccctggtcaacttctagttcccccacccttctactatgtataccgtctgacgccgggtntgggacaaaggcgcaataggntnacnncatcgatnnnnnnnnnnnnnnnnnnnnnnnnnnnnnnnnnnnnnnnnnnnnnnnnnnnnnn

SEQ ID NO: 274010 - DNA, 243 bp, Homo sapiens
  misc_feature: GYAE6OF02HO3T6.48.34.D01.1.454.CMB.1.raw
  modified_base (243)..(243): a, c, t, g, unknown or other
  misc_feature (243)..(243): n is a, c, g, or t
tcagagtatacatacacgaccggtgctcgatttagatcgtctgtgttgggtttgggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccgccctcctctatgtatactctgagcgggctggcaaggcgcatagn

SEQ ID NO: 274011 - DNA, 248 bp, Homo sapiens; identical to SEQ ID NO: 273874
  misc_feature: GYAE6OF02IHWLB.48.34.D01.1.454.CMB.1.raw
  modified_base (246)..(248): a, c, t, g, unknown or other
  misc_feature (246)..(248): n is a, c, g, or t

SEQ ID NO: 274012 - DNA, 244 bp, Homo sapiens
  misc_feature: GYAE6OF02F4MNY.48.34.D01.1.454.CMB.1.raw
  modified_base (244)..(244): a, c, t, g, unknown or other
  misc_feature (244)..(244): n is a, c, g, or t
tcagagtatacatacacgaccggtgctcgatttagatcgtctgtgttgggtttggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccaccctcctctatgtatactctgagcgggctggcaaggcgcatagn

SEQ ID NO: 274013 - DNA, 524 bp, Homo sapiens
  misc_feature: GYAE6OF02HGGI5.48.34.D01.1.454.CMB.1.raw
  modified_base (468)..(468): a, c, t, g, unknown or other
  misc_feature (468)..(468): n is a, c, g, or t
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatccggtcttcccctggcgccctgctccaggacncacctccgagacgcacagcggccctgggctcggcctggtcaacggtactaccctag

SEQ ID NO: 274014 - DNA, 246 bp, Homo sapiens; identical to SEQ ID NO: 273868
  misc_feature: GYAE6OF02FXRZ6.48.34.D01.1.454.CMB.1.raw
  modified_base (246)..(246): a, c, t, g, unknown or other
  misc_feature (246)..(246): n is a, c, g, or t

SEQ ID NO: 274015 - DNA, 510 bp, Homo sapiens
  misc_feature: GYAE6OF02F26WO.48.34.D01.1.454.CMB.1.raw
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatatactttgacaactgggccagggaaccctggtcaccgtctcctcagcctccaccaagggcccatcggtcttcccctgcgccctgctccaggagcacctccgagagcacagcggccctggctgcctggtcaaggactatcc

SEQ ID NO: 274016 - DNA, 283 bp, Homo sapiens
  misc_feature: GYAE6OF02HIMV7.48.34.D01.1.454.CMB.1.raw
  modified_base (242)..(251): a, c, t, g, unknown or other
  misc_feature (242)..(251): n is a, c, g, or t
  modified_base (253)..(283): a, c, t, g, unknown or other
  misc_feature (253)..(283): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtctaggtcagcccaaggctgcccctcggtcactctgttcccacctctctatgtatactctgagcgggctggcaaggcgcatagnnnnnnnnnntnnnnnnnnnnnnnnnnnnnnnnnnnnnnnnn

SEQ ID NO: 274017 - DNA, 316 bp, Homo sapiens
  misc_feature: GYAE6OF02IW4ZG.48.34.D01.1.454.CMB.1.raw
  modified_base (251)..(258): a, c, t, g, unknown or other
  misc_feature (251)..(258): n is a, c, g, or t
  modified_base (262)..(316): a, c, t, g, unknown or other
  misc_feature (262)..(316): n is a, c, g, or t
tcagagtatacatacacgaccggtgctcgatttagatcgtctgtggttgggtttggagggtgtggtggtctcccactcccgccttgacgaggcctgattactactgtcagtcttttgataacaacaatcacgtggtcttcggcggagggaccagcctgaccgtctaggtcagcccaaggctgccccctcggtcactctgttcccaccctcgtactatgtactcctctgagcgggctggcaaggcgcatagnnnnnnnntacnnnnnnnnnnnnnnnnnnnnnnnnnnnnnnnnnnnnnnnnnnnnnnnnnnnnnnn

SEQ ID NO: 274018 - DNA, 247 bp, Homo sapiens; identical to SEQ ID NO: 273861
  misc_feature: GYAE6OF02IOY3I.48.34.D01.1.454.CMB.1.raw
  modified_base (246)..(247): a, c, t, g, unknown or other
  misc_feature (246)..(247): n is a, c, g, or t

SEQ ID NO: 274019 - DNA, 247 bp, Homo sapiens; identical to SEQ ID NO: 273865
  misc_feature: GYAE6OF02ITSGE.48.34.D01.1.454.CMB.1.raw
  modified_base (246)..(247): a, c, t, g, unknown or other
  misc_feature (246)..(247): n is a, c, g, or t

SEQ ID NO: 274020 - DNA, 246 bp, Homo sapiens; identical to SEQ ID NO: 273868
  misc_feature: GYAE6OF02ISM0A.48.34.D01.1.454.CMB.1.raw
  modified_base (246)..(246): a, c, t, g, unknown or other
  misc_feature (246)..(246): n is a, c, g, or t

SEQ ID NO: 274021 - DNA, 538 bp, Homo sapiens
  misc_feature: GYAE6OF02GW1RR.48.34.D01.1.454.CMB.1.raw
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtcgagtttaacacgccgtcgggagggatattactttgacaacgtgggccagggaaccctggtcaccgtctcctcagcctccaccaaggcccatccggtcttcccctggccgccctcgcctccaggacgccacctccgagacgcaccagccggcccgtcgggcctcggcccgtggtccaacggtacctacgttacccg

SEQ ID NO: 274022 - DNA, 248 bp, Homo sapiens; identical to SEQ ID NO: 273874
  misc_feature: GYAE6OF02HXSGP.48.34.D01.1.454.CMB.1.raw
  modified_base (246)..(248): a, c, t, g, unknown or other
  misc_feature (246)..(248): n is a, c, g, or t

SEQ ID NO: 274023 - DNA, 549 bp, Homo sapiens
  misc_feature: GYAE6OF02HATDZ.48.34.D01.1.454.CMB.1.raw
  modified_base (338)..(338): a, c, t, g, unknown or other
  misc_feature (338)..(338): n is a, c, g, or t
tcagagtatacatacacgaccggtgctcgatttagatcgtctgtgttgggtaggcagttggtggagtcgggggaggtgtggtccagcctgggaagtccctgacacctgtcctgcgcagcctctggattcaccttcaccacctttcgtatgcactttgtccgccaggctccaggcaaggggctggagtgggtggctgttgtgtcaaatgatggacatgctagaatatgcagactccgtgagggccattcgcttctccagagacaattccaagagcacggttcatctgcaaatgagcgccctgagacctgacgacacggctgtctattactgtcgcgagngggcgtcgaagtttaacacgccgtcgggagggatatttactttgacgaactggggccagggaacctggtccaccgtctcctcagcctccacaaggcccatccggtctcccctggccgcctgcctccaggacgccaccgtccgagacgcctacgacgtccggaccctcgggcctcggcccgttggttacctaacggtacttaccgtttaccg

SEQ ID NO: 274024 - DNA, 247 bp, Homo sapiens; identical to SEQ ID NO: 273861
  misc_feature: GYAE6OF02FGEVI.48.34.D01.1.454.CMB.1.raw
  modified_base (246)..(247): a, c, t, g, unknown or other
  misc_feature (246)..(247): n is a, c, g, or t

SEQ ID NO: 274025 - DNA, 246 bp, Homo sapiens; identical to SEQ ID NO: 273876
  misc_feature: GYAE6OF02FVC3X.48.34.D01.1.454.CMB.1.raw
  modified_base (245)..(246): a, c, t, g, unknown or other
  misc_feature (245)..(246): n is a, c, g, or t

SEQ ID NO: 274026 - DNA, 246 bp, Homo sapiens; identical to SEQ ID NO: 273868
  misc_feature: GYAE6OF02GXYBN.48.34.D01.1.454.CMB.1.raw
  modified_base (246)..(246): a, c, t, g, unknown or other
  misc_feature (246)..(246): n is a, c, g, or t

SEQ ID NO: 274027 - DNA, 249 bp, Homo sapiens
  misc_feature: GYAE6OF02IKNE9.48.34.D01.1.454.CMB.1.raw
  modified_base (245)..(249): a, c, t, g, unknown or other
  misc_feature (245)..(249): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggaggaccagcctgaccgtcctaggtcagcccaaggctgccccctcggtcactctgttcccaccctcctctatgtatactctgagcgggctggcaaggcgcatagnnnnn

SEQ ID NO: 274028 - DNA, 247 bp, Homo sapiens; identical to SEQ ID NO: 273861
  misc_feature: GYAE6OF02HCLH0.48.34.D01.1.454.CMB.1.raw
  modified_base (246)..(247): a, c, t, g, unknown or other
  misc_feature (246)..(247): n is a, c, g, or t

SEQ ID NO: 274029 - DNA, 246 bp, Homo sapiens; identical to SEQ ID NO: 273868
  misc_feature: GYAE6OF02HVZE1.48.34.D01.1.454.CMB.1.raw
  modified_base (246)..(246): a, c, t, g, unknown or other
  misc_feature (246)..(246): n is a, c, g, or t

SEQ ID NO: 274030 - DNA, 539 bp, Homo sapiens
  misc_feature: GYAE6OF02GCKJ4.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggaggatattactttgacaacgtgggccagggaaccctggtcaccgtctcctcagcctccaccaacgggcccatccgtcttcccctggccgccctgcctccgacggacgccaccctccgagacgccacgacgccggccctgggcctcgccgtggtccaacggaccttacgttaccg

SEQ ID NO: 274031 - DNA, 247 bp, Homo sapiens
  misc_feature: GYAE6OF02GEDBV.48.34.D01.1.454.CMB.1.raw
  modified_base (247)..(247): a, c, t, g, unknown or other
  misc_feature (247)..(247): n is a, c, g, or t
tcagagtatacatacacgaccggtgctcgatttagatcgtctgtgttgggtttggagggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagn

SEQ ID NO: 274032 - DNA, 514 bp, Homo sapiens
  misc_feature: GYAE6OF02GUVOM.48.34.D01.1.454.CMB.1.raw
  modified_base (465)..(465): a, c, t, g, unknown or other
  misc_feature (465)..(465): n is a, c, g, or t
  modified_base (476)..(476): a, c, t, g, unknown or other
  misc_feature (476)..(476): n is a, c, g, or t
tcagagtatacatacacgaccggtgctcgatttagatcgtctgtgttgggtttgggggaagaggaagactgacggtcctgccacaggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcgtctcccctgcncctgctccagngcacctccgagacgcacagcggccctgggctgcctcgg

SEQ ID NO: 274033 - DNA, 246 bp, Homo sapiens; identical to SEQ ID NO: 273862
  misc_feature: GYAE6OF02H50H7.48.34.D01.1.454.CMB.1.raw
  modified_base (246)..(246): a, c, t, g, unknown or other
  misc_feature (246)..(246): n is a, c, g, or t

SEQ ID NO: 274034 - DNA, 247 bp, Homo sapiens; identical to SEQ ID NO: 273861
  misc_feature: GYAE6OF02G0G72.48.34.D01.1.454.CMB.1.raw
  modified_base (246)..(247): a, c, t, g, unknown or other
  misc_feature (246)..(247): n is a, c, g, or t

SEQ ID NO: 274035 - DNA, 247 bp, Homo sapiens; identical to SEQ ID NO: 273865
  misc_feature: GYAE6OF02IDB31.48.34.D01.1.454.CMB.1.raw
  modified_base (246)..(247): a, c, t, g, unknown or other
  misc_feature (246)..(247): n is a, c, g, or t

SEQ ID NO: 274036 - DNA, 249 bp, Homo sapiens
  misc_feature: GYAE6OF02ICMKG.48.34.D01.1.454.CMB.1.raw
  modified_base (246)..(249): a, c, t, g, unknown or other
  misc_feature (246)..(249): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnnnn

SEQ ID NO: 274037 - DNA, 247 bp, Homo sapiens; identical to SEQ ID NO: 273865
  misc_feature: GYAE6OF02FUIUX.48.34.D01.1.454.CMB.1.raw
  modified_base (246)..(247): a, c, t, g, unknown or other
  misc_feature (246)..(247): n is a, c, g, or t

SEQ ID NO: 274038 - DNA, 247 bp, Homo sapiens; identical to SEQ ID NO: 273865
  misc_feature: GYAE6OF02GKNG7.48.34.D01.1.454.CMB.1.raw
  modified_base (246)..(247): a, c, t, g, unknown or other
  misc_feature (246)..(247): n is a, c, g, or t

SEQ ID NO: 274039 - DNA, 576 bp, Homo sapiens
  misc_feature: GYAE6OF02IHQBE.48.34.D01.1.454.CMB.1.raw
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagagtatacatacacgaccggtgctcgatttagatcgtctgtgttggggttgggggctgtgggctcaggaggcagagctctgggaatctcaccatggcctggacccctctcctgcctccccctcctcactttctgcacagtctctgaggcctcctctgagctgacacagcccaccctcggtgtcagtgtccccaggacaaacggccaggatcacctgctctgganatgcattgaccaaagtaaaattttgttattggtaccaatgaagtcaggccaggcccctgtcctggtctatttanggaggacgaccngccgaccctcgaggactccctgcgtaggttctcgtggactcgaactcgagggactagttcggaccctaccgtttgaaccttatccgacggtcggggcccgtagggtgggaggagtaggaaggtcgtacttacgttcttgtttctacaacagaccacgagtacgaacaatcatgacgtagtttcggacggaggaccgagcgtcgaccgtcgcggtcacgacccgaggcctccgccccgtcggtcctaccgtccgtccgtccccg

SEQ ID NO: 274040 - DNA, 245 bp, Homo sapiens
  misc_feature: GYAE6OF02GYJPP.48.34.D01.1.454.CMB.1.raw
  modified_base (245)..(245): a, c, t, g, unknown or other
  misc_feature (245)..(245): n is a, c, g, or t
tcagagtatacatacacgaccggtgctcgatttagatcgtctgtgttgggtttgggggtgtggtggtctccactcccgccttgacgaggctgattactactttcagtcttttgataacaacaatcacgtggtcttcggcggagggaccagcctgaccgtcctaggtcagcccaaggctgccccctcggtcactctgttccgccctcctctatgtatactctgagcgggctggcaaggcgcatagn

SEQ ID NO: 274041 - DNA, 247 bp, Homo sapiens; identical to SEQ ID NO: 273861
  misc_feature: GYAE6OF02HFKQ9.48.34.D01.1.454.CMB.1.raw
  modified_base (246)..(247): a, c, t, g, unknown or other
  misc_feature (246)..(247): n is a, c, g, or t

SEQ ID NO: 274042 - DNA, 550 bp, Homo sapiens
  misc_feature: GYAE6OF02GX91C.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaagagcacggttcatctgcaaatgagcgccctgagacctgacgacacggctgtctattactgtgcgagagggcgtcgagtttaacacgccgtcgggaggatattactttgactaacgtggggccagggaaccctggtcaccgtctcctcagcctccaccaagggcccagtccgtccttccccgtggccgccctgcctccgaggacgccaccctccgacgacgccacgacggccggcccgtcgggcctcggcccgttggccgaacggtaccttaccgttacccg

SEQ ID NO: 274043 - DNA, 536 bp, Homo sapiens
  misc_feature: GYAE6OF02GPGEQ.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactcgtgagggccattcgcttctccagagacaattccaagagcacggttcatctgcaaatgagcgccctgagacctgacgacacggctgtctattactgtgcgagaggcgtccgagtttaacacgccgtcgggaggatattacttgacaacgtgggccagggaaccctggtcaccgtctcctcacgcctccaccaacgggcccagtccggtccttcccctggcccgccctcgcctccgaggacgcacctccgagacgcacacggccggccctgggcctcggcctggtaccgaacggtacctacttcccg

SEQ ID NO: 274044 - DNA, 530 bp, Homo sapiens
  misc_feature: GYAE6OF02GQS4C.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattacttgacaactgggccagggaaccctggtcaccgtctcctcacgcctccaccaacgggcccatccggtcttccccctggccgccctcgcctccacggacgccacctccgagacgcacagccggccctcgggctcgcctggtcaacggactacttcc

SEQ ID NO: 274045 - DNA, 294 bp, Homo sapiens
  misc_feature: GYAE6OF02GYAXB.48.34.D01.1.454.CMB.1.raw
  modified_base (255)..(294): a, c, t, g, unknown or other
  misc_feature (255)..(294): n is a, c, g, or t
tcagagtatacatacacgaccggtgctcgatttagatcgtctgtgttgggtttggggggtgtcggtggtctcctactcccgccttgacgaggctgattactactgtcagtcttttgataacaacaatcacgtggtcttcggcggagggacctagcctgaccgtccttaaggtcagcccaaggctgccccctcggtcactctgttcccgcccgtcctctatgtagtacctctgagcgggctggcaaggcgcatagnnnnnnnnnnnnnnnnnnnnnnnnnnnnnnnnnnnnnnnn

SEQ ID NO: 274046 - DNA, 247 bp, Homo sapiens; identical to SEQ ID NO: 273861
  misc_feature: GYAE6OF02F7DGH.48.34.D01.1.454.CMB.1.raw
  modified_base (246)..(247): a, c, t, g, unknown or other
  misc_feature (246)..(247): n is a, c, g, or t

SEQ ID NO: 274047 - DNA, 540 bp, Homo sapiens
  misc_feature: GYAE6OF02HQ4WS.48.34.D01.1.454.CMB.1.raw
tcagagtatacatacacgaccggtgctcgatttagatcgtctgtgttgggtttggggggaagaggaagactgacggtcctgccacaggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggattatactttgacaacgtggggccagggaaccctggtcaccgtctcctcagcctccaccaagggcccagtcggtccttccccgtggccgccctcgcctccgacggacgccgacctccgagacgcacgacgccggaccctgggcctcggccctcgg

SEQ ID NO: 274048 - DNA, 534 bp, Homo sapiens
  misc_feature: GYAE6OF02I34TV.48.34.D01.1.454.CMB.1.raw
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaaagagcacggttcatctgcaaatgagcgccctgagacctgacgacacggctgtctattactgtgcgagagggcgtccgagtttaacacgcgtcgggagggatatttactttgacaactgggccagggaaccctggtcaccgtctcctcacgcctccaccaacgggcccatccggtcttcccctggccnccctgcctccacggcncacctccgagacgcacgacgcggccctcgggctcggccgtcggtccaaggtacctacttccg

SEQ ID NO: 274049 - DNA, 548 bp, Homo sapiens
  misc_feature: GYAE6OF02HPV4T.48.34.D01.1.454.CMB.1.raw
  modified_base (364)..(364): a, c, t, g, unknown or other
  misc_feature (364)..(364): n is a, c, g, or t
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtcgagttacacgccgtcggaggntattacttgacacgtgggccaggaacctggtcaccgtctcctcacgcctccaccaacgggcccacgtccggtccttcccccgtggcccgcccgtcgcctccgacgggacgccgacctccgacgacgccacgcgccggcccgtcgggcctcggcccgtcggtaccgaacggtacctacgttcccg

SEQ ID NO: 274050 - DNA, 617 bp, Homo sapiens
  misc_feature: GYAE6OF02I6DQC.48.34.D01.1.454.CMB.1.raw
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagggccattcgccttctccagagacaattccaaagagcacggttcatctgcaaatgagcgccctgacacctgaacgacacggctgtctaattactgtgcgagacgggctccgaagtttaacacgtccggtgggagggtatactttacgttgactaacgtggggaccagggaactcgtggtctaccgtctccgtcacgtccctcgaaccgaacgggcccaagttccggtcccttcccccgtaggtccgtcccgtacgtcctacccgacggtaaccgtccacccgttccgaacggtaccgaccgaaccgaccggacccgggtccccgttcggggacccttccggtccccgttagggtacccgtaacgggtaccctttaaccccgg

SEQ ID NO: 274051 - DNA, 254 bp, Homo sapiens
  misc_feature: GYAE6OF02FF7DQ.48.34.D01.1.454.CMB.1.raw
  modified_base (247)..(254): a, c, t, g, unknown or other
  misc_feature (247)..(254): n is a, c, g, or t
tcagagtatacatacacgaccggtgctcgatttagatcgtctgtgttgggtttgggggtgtggtggtctccactcccgccttgacgaggctgattactactgtcagtctttgataacaacatcacgtggtctcggcggaggaccagcctgaccgtcctaggtcagcccaaggcctcgcccccctggtcactctgttccccaccctcctctatgtatactctgagccgggctgggcaaggcgcatagnnnnnnnn

SEQ ID NO: 274052 - DNA, 701 bp, Homo sapiens
  misc_feature: GYAE6OF02G5AWV.48.34.D01.1.454.CMB.1.raw
  modified_base (218)..(218): a, c, t, g, unknown or other
  misc_feature (218)..(218): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggtttggggctgtgggctcaggaggcagagctctgggaatctcaccatggcctggacccctctcctgcctccccctctcactttcngcacagtctctgagccctcctctgagctgacacacgcccaccctcggtgtacagtcgtccccaggaccaaacggccaggactcacctgcctcgtggagatcgactagttcgacctaaagttaaatttttgtaattacgggtaacctaacgtagaacgtcgacggacccgtacggtccccttggttacccgttggttacctaagttttacgtacggaacgggaccgaaccgaacgtacccggtaaccccgtaccgaacgggtaccttcccgtagggtaccgttacggtttcctacggttacggaacgttaccggtaaacgttcggaacgggtactacggtttaccggacccttaaccgttcgtaaccttacgtccgtaaccggtacgggacccgtaggggtacggacggtacgtagggaacggttgtaaccgttacgttctttacggtttacctacgtaaaccgtacgaacctaccgtagtacg

SEQ ID NO: 274053 - DNA, 248 bp, Homo sapiens; identical to SEQ ID NO: 273874
  misc_feature: GYAE6OF02INPEZ.48.34.D01.1.454.CMB.1.raw
  modified_base (246)..(248): a, c, t, g, unknown or other
  misc_feature (246)..(248): n is a, c, g, or t

SEQ ID NO: 274054 - DNA, 246 bp, Homo sapiens; identical to SEQ ID NO: 273868
  misc_feature: GYAE6OF02GJDQH.48.34.D01.1.454.CMB.1.raw
  modified_base (246)..(246): a, c, t, g, unknown or other
  misc_feature (246)..(246): n is a, c, g, or t

SEQ ID NO: 274055 - DNA, 704 bp, Homo sapiens
  misc_feature: GYAE6OF02IDPHP.48.34.D01.1.454.CMB.1.raw
  modified_base (623)..(623): a, c, t, g, unknown or other
  misc_feature (623)..(623): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagacctccgtggacgggccattccgccttctccagagacaattccaagacgcacggttcatctgacaaatgacgccgcctagacgacctggaccgacgacggtctgtacttattacgtggtcgacgaggacggggtccgttaccggtaacgttttaaccgccgggtacccggtacgggggtaagggttaactttaacgttttaaccgtttacggaaccgtaaccgggttaccgggggaaccccgtaacggggtaaccccgttacgggttaccctaacccggttcctacccgttaccgaccgtaccccgtacccgaacccggaaacccgggtcccctacgttccccggttcccctttcccccggtcggcccctcccgtcgtcccgtaccgacggtaccncccgtacccgacgacgacgaccgaccggaccggcccggcccgtggcctcggccgtcggaccgtaacgttccttacttaccg

SEQ ID NO: 274056 - DNA, 565 bp, Homo sapiens
  misc_feature: GYAE6OF02HUWY8.48.34.D01.1.454.CMB.1.raw
  modified_base (490)..(490): a, c, t, g, unknown or other
  misc_feature (490)..(490): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaagagcacggttcatctgacaaaatgagcgccctgagacctgacgacacggctgtctattactgtgcgagagggcgtcgagtttaacacgccgtcgggaggtatatttacgttgacaacgtgggaccacgggaacccttgggtcaccgtctcctcacgcctacccaccgaacggacccatccggtccttcccccgtcggcccgcccgtcgcctccgacggacnccgaccctccgacgacgcacgacggccggccctcgggcctcggccgtcggtaccgaacggtacctaccgttaccg

SEQ ID NO: 274057 - DNA, 548 bp, Homo sapiens
  misc_feature: GYAE6OF02IE021.48.34.D01.1.454.CMB.1.raw
  modified_base (463)..(463): a, c, t, g, unknown or other
  misc_feature (463)..(463): n is a, c, g, or t
  modified_base (511)..(511): a, c, t, g, unknown or other
  misc_feature (511)..(511): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagggccattcgccttctccagagacaattccaagagcacggttcatctgcaaatgagcgccctgagacctgacgacacggctgtctattactgtgcgagagggcgtaccgagtttaacacggccgtcgggagggatagtttacgtttgacacgtgggaccagggaaccctggtcaccgtctcctcacgtcctaccaccacggccctatccggtccttccccgtggccnccctgcctccgacgacgcaccctcgacgcgacgaccgagccggcccgngggcctcggccgtcggccaacggtccttacgttcccg

SEQ ID NO: 274058 - DNA, 562 bp, Homo sapiens
  misc_feature: GYAE6OF02H2R6C.48.34.D01.1.454.CMB.1.raw
  modified_base (253)..(253): a, c, t, g, unknown or other
  misc_feature (253)..(253): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagagtatacatacacgaccggtgctcgatttagatcgtctgtgttgggtgcagttggtggagtcgggggagggtggtggtccagcctgggaagtccctgacactgtcctgcgcagcctctggattcaccttcaccacctttcgtatgcactttgtccgccaggctccaggcaaggggctggagtgggtggctgttgtgtcaaaatgatggacatgctgaatatgcagactccgtgagggcgattcgccttntccagagacaattccaagagcaacggttcatctgcaaatgagcgccctgacacctgacgacacggctgtctattactgtgcgagaggcgtccgagtttaacacgccgtaggggagggatatttactttgaactaacgtggggtaccgaagggaaccctggtaccaccgtctcctcagcctcccacaacgggcccagtccggtcttcccccgtgccgcccgtcgcctccnggacncgaccctcgacgacgcaccgacgccggcccgtcggcgtcgcccgtcggtaccggaacgtaccgtaacctttcccg

SEQ ID NO: 274059 - DNA, 249 bp, Homo sapiens
  misc_feature: GYAE6OF02GDCEO.48.34.D01.1.454.CMB.1.raw
  modified_base (246)..(249): a, c, t, g, unknown or other
  misc_feature (246)..(249): n is a, c, g, or t
tcagagtatacatacacgaccggtgctcgatttagatcgtctgtgttgggtttgggggtgtggtggtctccactcccgtcttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnnn

SEQ ID NO: 274060 - DNA, 555 bp, Homo sapiens
  misc_feature: GYAE6OF02HX2CJ.48.34.D01.1.454.CMB.1.raw
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(534): a, c, t, g, unknown or other
  misc_feature (532)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(542): a, c, t, g, unknown or other
  misc_feature (540)..(542): n is a, c, g, or t
  modified_base (544)..(547): a, c, t, g, unknown or other
  misc_feature (544)..(547): n is a, c, g, or t
  modified_base (549)..(555): a, c, t, g, unknown or other
  misc_feature (549)..(555): n is a, c, g, or t
tcagagtatacatacacgaccggtgctcgatttagatcgtctgtgttgggtttggggagggcagttggtagatgcccctctgggagagatccccaggggtgacagccatggaccctggaagggcctgggctagggacagggaccagagccagtccagggagaggacagagccaatggactggggtgtactgtaacagccctgctggtcccaggcagcgctggcccctgctgctgctgggtctggccatggtcgccatggcctgctgcgccaatggtgcaccgcaaacggccggggacccagaccccgtggacgcctcagttggaagcagccgatccagcctgccggacgccgtggtacggggcaacggtcgaacgaccccgaaagggaccccaaaccccgtactcgtaccaccgttcctcgtttacccccgccccttcctccgtaattcgttacttaacctcgtacgacgtccggggtctacgggaccgtaaagggccgaaccgtaagtaacggcncgtagcgcgncncncnnncncncnnncnnnncnnnnnnn

SEQ ID NO: 274061 - DNA, 598 bp, Homo sapiens
  misc_feature: GYAE6OF02H2I0W.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggcgattcgccttctccagagacaattccaagagcacggttcatctgcaaatgagcgccctgacgacctgacgacacggctgtactattactgtgcgagagggcgtacgagtttaacgacgcgtacggggaggatatttacttgacgaacgtcggggaccagggtaaccctggtcaccgtcctctcgacgccctaccgaccgaaccgggccctacgtaccggttccttcccccgtgggcccgtccccgtcgtccgttacccgacgggtacgcccgtacccgtcccgacgacgtccaccgacggtcccggccccgttcgggcctcggcccgtggtaccgtaacggtaccctactttacccg

SEQ ID NO: 274062 - DNA, 598 bp, Homo sapiens
  misc_feature: GYAE6OF02FPIIW.48.34.D01.1.454.CMB.1.raw
  modified_base (157)..(157): a, c, t, g, unknown or other
  misc_feature (157)..(157): n is a, c, g, or t
  modified_base (276)..(277): a, c, t, g, unknown or other
  misc_feature (276)..(277): n is a, c, g, or t
  modified_base (280)..(280): a, c, t, g, unknown or other
  misc_feature (280)..(280): n is a, c, g, or t
  modified_base (290)..(291): a, c, t, g, unknown or other
  misc_feature (290)..(291): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
tcagagtatacatacacgaccggtgctcgatttagatcgtctgtgttggggtttggggggtagtggtcggtctcctacgtcccgaccttggaccgaggtcgtagacttacgtacgtcgtcagtcttttgactaacgaacaatcacgtggtcttcggnggtaggaccagcctgtaaccgtccgtaggtcagtcccaaggctgccccctggtccactctcgttcccaccgtcctctagtgtagtactactgacgcgggctgggcaaggcgcgagtagnnagnactgcgtgcnncagacngacgngatccgagctcgncatcagatgatgcgagnggccngttcanctcgcgcgtgtagtgcgngngtgtgacgacgacgtacgtacgacgtacgtacgacgtactacgacgacgtacgtacgacgtacgtacgtacgaacgtaagttaagttagtacgtaacgtaactacgtacgtactacgtacgtagtagtacgtacgtacgtacgtaacgtacgtacgtacgtacggacggacggacggtacggtacgtacgtacgtaacgtaacgtacgtacgtcgtcgtacgtaccgtacgtacg

SEQ ID NO: 274063 - DNA, 557 bp, Homo sapiens
  misc_feature: GYAE6OF02HZVI4.48.34.D01.1.454.CMB.1.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagagtatacatacacgaccggtgctcgatttagatcgtctgtgttggggttgggggctgtgggctcaggaggcagagctctgggaatctcaccatggcctggacccctctcctgctccccctcctcactttctgcacagtctctgaggcctcctctgagctgacacagccaccctcggtgtcagtcgtccccaggacaaacggccaggatcacctgcctctggagatgcattgaccaaagtaaaattttgtattggtaccaactgaagtcaggccaggcccctgtcctggtcatttangaggacgaccngccgaccctcaggactccctgcgtagttctctggactcgaactcgagggacattcggcctacttgactatcacgtggggccagggtggaggatggaaggtgacttacgttcgttcgtttctacaacagaccaacagtacgaactaatcatgcgtagtttcggcggacggaacgagcgtacgaccgtccgtggtaccacgcccgtaaggccgtcggcccccgtcggtcctacttccgtcgttccccg

SEQ ID NO: 274064 - DNA, 655 bp, Homo sapiens
  misc_feature: GYAE6OF02I91E0.48.34.D01.1.454.CMB.1.raw
tcagagtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgaccaaagtaaaattttgttattggtaccaactgaagtcaggccaggcccctgtcctggtcatttatgaggacgaccagccgaccctccgaggactcccgtgcgaggttctctggatcgaactcgaagggacagtttcggccctacgttcgaactatccgacgtcgggggaccctagggtgggaaggtagtaggaagggtgtaaccgttacgtttcgttcgttttcctactaaccgaagaccaacctaggtacgaaccaaagtctaagttacgtacgttacgtttttacgggacggggtaacgggaaccgaaaggtaccgtacggtacccgtccggttgggtaccgacggacccgaacgggtcccgtccggtcccccgttaccgggttcctacccgttcccgtccgtttacccccacccttccccg

SEQ ID NO: 274065 - DNA, 405 bp, Homo sapiens
  misc_feature: GYAE6OF02F5PSY.48.34.D01.1.454.CMB.1.raw
  modified_base (398)..(405): a, c, t, g, unknown or other
  misc_feature (398)..(405): n is a, c, g, or t
tcagagtatacatacacgaccggtgctcgatttagatcgtctgtgttgggtttgggatctacgttgcaggtgtaggtctgggtgccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaaggctacttcctatgtatactctgagcgggctggcaagggcgcatagnnnnnnnn

SEQ ID NO: 274066 - DNA, 533 bp, Homo sapiens
  misc_feature: GYAE6OF02IK8K7.48.34.D01.1.454.CMB.1.raw
  modified_base (472)..(472): a, c, t, g, unknown or other
  misc_feature (472)..(472): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaagagcacggttcatctgcaaatgagcgccctgagacctgacgacacggctgtctattactgtgcgagagggctccgagtttaacacgccgtcgggagggatatttactttgacaacgtgggccagggaaccctggtcaccgtctcctcacgcctccaccaacggcccatccggtcttccccgtggccgccctgctccgacgganccacctccgacgacgcaacagccggccctcgggctcgccgtggtcaacggacctacttacc

SEQ ID NO: 274067 - DNA, 561 bp, Homo sapiens
  misc_feature: GYAE6OF02I3R2B.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtcgtagtttaacacgccgtcggggaggatattactttgacaacgtgggccacgggacctggtcaccgtctctcacgctccaccacgggcccatccggtccttccccgtggccgccctcgcctccgacggacgccacccgtccgagacgccgacgacggcccggcccgtcgggccttcggcccgttacgggtaccgaacgggtaccttaccgtttacccg

SEQ ID NO: 274068 - DNA, 271 bp, Homo sapiens
  misc_feature: GYAE6OF02FH6IC.48.34.D01.1.454.CMB.1.raw
  modified_base (244)..(244): a, c, t, g, unknown or other
  misc_feature (244)..(244): n is a, c, g, or t
  modified_base (250)..(271): a, c, t, g, unknown or other
  misc_feature (250)..(271): n is a, c, g, or t
tcagagtatacatacacgaccggtgctcgatttagatcgtctgtgttgggtttgggagtgtggtggtctccactcccgccgttcgacgaggctgattacgtactgtcagtcttttgataacaacaatcacgtggtcttcggcggagggaccagcctgaccggtcctaggtcagcccaaggcctgccccctggtcactctgttcccaccctcctctatgtatactctgagcgggctggcaaggcncatagnnnnnnnnnnnnnnnnnnnnnn

SEQ ID NO: 274069 - DNA, 569 bp, Homo sapiens
  misc_feature: GYAE6OF02HGWXP.48.34.D01.1.454.CMB.1.raw
  modified_base (478)..(478): a, c, t, g, unknown or other
  misc_feature (478)..(478): n is a, c, g, or t
  modified_base (499)..(499): a, c, t, g, unknown or other
  misc_feature (499)..(499): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaagagcacggttcatctgacaaatgacgcgccctgacgacctgacgacgacggctgtctattactgtgcgagacgggcgtcgagtttaaccgacgtccggtcgggaggtatagtttacgtttgaactaacgtcggggaccacgggtaaccctggtccaccgtctccctcacgccctaccaccgaacgggcccacgtccggtccttccccgngcccgccctgcctccgaggcnccacctcgacgacgccacgcgccggcccgtgggcctcggtccgtggtaccaacggtaccttaccttaccg

SEQ ID NO: 274070 - DNA, 248 bp, Homo sapiens
  misc_feature: GYAE6OF02ION6V.48.34.D01.1.454.CMB.1.raw
  modified_base (247)..(248): a, c, t, g, unknown or other
  misc_feature (247)..(248): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttccccaccctcctctatgtatactctgagcgggctggcaaggcgcatagnn

SEQ ID NO: 274071 - DNA, 246 bp, Homo sapiens
  misc_feature: GYAE6OF02H98BA.48.34.D01.1.454.CMB.1.raw
  modified_base (245)..(246): a, c, t, g, unknown or other
  misc_feature (245)..(246): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccgccctcctctatgtatactctgagcgggctggcaaggcgcatagnn

SEQ ID NO: 274072 - DNA, 651 bp, Homo sapiens
  misc_feature: GYAE6OF02HR96F.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgacggggccattcgccttctccagagacaattccaagagcacggttcatctgacaaatgacgcgccctgacacctgacgacacggctgtctattacgtgtgcgaggacggggcgttccgtagtttaaaccgacggtccggtacggggaagggtattaactttacgtttaggaacgtaaacggttcggggaccgaacggggtaaccccgttcggtacccgtaacccggtccttcccgtccgaaccggtccccttaccccgaaacccgtaaccgggcccctagtccccggttccctttcccccgtcggcccgtcccctcgcccgttccgaaggaccgcccaccgtccgaggacgccgaacgcggcccggcccgtcgggccttcggccgttaggtaccgaacggttacctaccgttaccg

SEQ ID NO: 274073 - DNA, 810 bp, Homo sapiens
  misc_feature: GYAE6OF02ILT60.48.34.D01.1.454.CMB.1.raw
  modified_base (658)..(658): a, c, t, g, unknown or other
  misc_feature (658)..(658): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctactttcgtccgccaggctccaggcaagggctggagtgggtgctgttgtgtcaatgatggacatgctagaatatgcagtactccggtggacggggcctatttccgcctttcctaccgaagacgaactaacttccaagacgctaacggttcatcgtagacaaatcggacgccgaccctaggaccgtacctacggaaccgacgacggtcttaggttacttaaacgtttccgtggttacggacggtaacgggtcggggtacccgtttaccggtaaacgttttaacccgaccggggtcccgggtacggggggtaacgggttaacttttaacgttttaaccggtttacggaaaccggtaaccgggttacggggggaacccctaaaccgggggtaaccccgttgggttacccgtaacccggtttcccttcccgtaccgtaccggtaccccttaacccggaaacccggtaaccgggtcccctaacggttccccgggtttccctttacccccgggnggttaccccgcccgttcgccgttaacccggaggtacccctccgtaacccgttccggaacgaccgtcccgaaaccggccgggacccgttccccggtgggtaccctcgggttacccgtcgggttaaacccgacggttaccctttaccttaccgg

SEQ ID NO: 274074 - DNA, 377 bp, Homo sapiens
  misc_feature: GYAE6OF02GU4O2.48.34.D01.1.454.CMB.1.raw
  modified_base (345)..(345): a, c, t, g, unknown or other
  misc_feature (345)..(345): n is a, c, g, or t
  modified_base (369)..(377): a, c, t, g, unknown or other
  misc_feature (369)..(377): n is a, c, g, or t
tcagagtatacatacacgaccggtgctcgatttagatcgtctgtgttgggtttggggggaagaggaagactgacggtcctgccacaggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgcctgacgacctgacgacacggctgtctattacngagcgggctggcaaggcgcatagnnnnnnnnn

SEQ ID NO: 274075 - DNA, 248 bp, Homo sapiens
  misc_feature: GYAE6OF02GQCXK.48.34.D01.1.454.CMB.1.raw
  modified_base (247)..(248): a, c, t, g, unknown or other
  misc_feature (247)..(248): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnn

SEQ ID NO: 274076 - DNA, 559 bp, Homo sapiens
  misc_feature: GYAE6OF02JEUYY.48.34.D01.1.454.CMB.1.raw
  modified_base (337)..(337): a, c, t, g, unknown or other
  misc_feature (337)..(337): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagngggcgtcgagtttaacacgccgtgggagggatagttacttgacaacgtggggccagggaccctggtcaccgtctcctcacgcctccaccgacggcccacgtccgtccttccccgtggcccgtccctgcctccgacggacgccaccgtccgagacgccgacgtacggcccggccctcggggccttcggcccgttggtaccaacgggtaccttacctttacccg

SEQ ID NO: 274077 - DNA, 577 bp, Homo sapiens
  misc_feature: GYAE6OF02HVD3L.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaagagcacggttcatctgcaaatgagcgccctgagacctgacgacacggctgtctattactgtgcgagagggcgtccgagtttaacacgccgtcgggagggatatactttgacaacgtggggacgacggaaccctggtacaccgtctccctcacgcccttccaacccgaacgggccccagtccggttacccttcccccgtagggcccgccccgtgcccgttcccgacgggacgccacccgtccgacgacgcaaccgcggccggccctcgggcctcggcccgttaggtaccaacggtccttacgttacccg

SEQ ID NO: 274078 - DNA, 249 bp, Homo sapiens; identical to SEQ ID NO: 273863
  misc_feature: GYAE6OF02JC9MP.48.34.D01.1.454.CMB.1.raw
  modified_base (246)..(249): a, c, t, g, unknown or other
  misc_feature (246)..(249): n is a, c, g, or t

SEQ ID NO: 274079 - DNA, 708 bp, Homo sapiens
  misc_feature: GYAE6OF02HHCTZ.48.34.D01.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (318)..(318): a, c, t, g, unknown or other
  misc_feature (318)..(318): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggtttggggctgtgggctcaggaggcagagctctgggaatctcaccatggcctggacccctntcctgcctccccctctcactttcngcacagtctctgacggcctcctctgacgctgacacacgccctacctcggtgtcagtcgtccccaggaccaaacggccaaggactcacctgctcgtagganatcgctattcgacctaaagttaaattttgtaattcggtaacctaaactgaacgtcacggaccacggccctgtacctggtactatttacgcggaacggaccgaccgacgcccgtaaccccgtcgaacgggtaccttcccgtaggccggttacggtttcctcgttacggtacgttaccgaaacttcggaacgggtactacggtttaccgggacccttaaccgtttaggaaacctttacttacccggtaaccgggttccggggaaccccgttaaggggtacggggtaacggttaacgttacgggtaaacgggttacggtaacccttacggttttaccgtttaggttttaccctaaccggaaaccgtacggtaacccgtaccgtaggttaaccg

SEQ ID NO: 274080 - DNA, 620 bp, Homo sapiens
  misc_feature: GYAE6OF02IDY1L.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaaagagcacggttcatcctgacaaatgagcgccctgacgacctgacgacacggctgtctattactgtcgcgaggagggtctacgtaagttaaccgcgccgtacggggaggtattagtttacgttgaacgtaacgtcgggaccgtagggaaccctggtcaccgtctcctcacgtcctaccaacgacggcctagtccggttccttccccgtaggccctcccgtcgtcccgtaccgacggacgacccgaccgtccgacgaccgtaccgaaccgtacgggtcccggtacccccgttgggtcccgtaccggtcccggttacgggttaccggaaacggttaccccttaccgtttacccg

SEQ ID NO: 274081 - DNA, 559 bp, Homo sapiens
  misc_feature: GYAE6OF02FMN1G.48.34.D01.1.454.CMB.1.raw
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagggccgattcgccttctccagagacaattccaagagcacggttcatctgacaaatgagcgccctgagacctgacgacacggctgtctattactgtgcgagagggcgtaccggagtttaacacgccgtcggggaggattattacttgacacgtgggccagggaaccctggtccaccgtctcctcacgcctccaaccgacggcccagtccggtccttccccgnggcccnccctgccctccgaggacgccacccgtccgagcgaccgacgacggcccggtcccgtcgggctccggccttacgggacaacggtccttacccgttccc

SEQ ID NO: 274082 - DNA, 648 bp, Homo sapiens
  misc_feature: GYAE6OF02GS4TV.48.34.D01.1.454.CMB.1.raw
tcagagtatacatacacgaccggtgctcgatttagatcgtctgtgttggggttgggggctgtgggctcaggaggcagagctctgggaatctcaccatggcctggacccctctccctgcctccccctcctcactttctgcacagtctctgaggcctcctctcgagctgacacagcccaccctcggtgtcagtcgtccccaggaccaaacggccaggtatcacctgcctcgtggagatgcattgacctaaagtaaaatttttgttaacttcggaacctaactgaaagtcaaggcccacggccccctgtcctggtcctattttagaggaggtaccgaccagaccgaccctcaggacctcccgtgcggtacgttctcgtaggactcgaactcgaagggtacagttcggacctaccgttgactagtcgacgtcgggccgtaggtacgggagagtaggtaaggtagtacttacgttcgttacgtttctactacgtacaccgactacgtcgtaacaactactacgtagtacgtacgtttacgggacggtacggaacgtacgaccgtcgtaccgtccggtcggtacggaccgtacccgtaacggtcccgtacccggtcccccgtcggttaccctaccgtccgttcccgtacccccg

SEQ ID NO: 274083 - DNA, 251 bp, Homo sapiens
  misc_feature: GYAE6OF02H22J4.48.34.D01.1.454.CMB.1.raw
  modified_base (247)..(251): a, c, t, g, unknown or other
  misc_feature (247)..(251): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctcgttcccaccctcctctatgtatactctgagcgggctggcaaggcgcatagnnnnn

SEQ ID NO: 274084 - DNA, 423 bp, Homo sapiens
  misc_feature: GYAE6OF02I6YHK.48.34.D01.1.454.CMB.1.raw
  modified_base (311)..(311): a, c, t, g, unknown or other
  misc_feature (311)..(311): n is a, c, g, or t
  modified_base (411)..(423): a, c, t, g, unknown or other
  misc_feature (411)..(423): n is a, c, g, or t
tcagagtatacatacacgaccggtgctcgatttagatcgtctgtgttgggtttgggatctacgttgcaggtgtaggtctgggtgccgattcgccttctccagagacaattccaagagcacggttcatctgcaaatgagcgccctgagacctgacgacacggctgtctattactgtgcgagagggcgtccgagtttaacacgccgtcgggaggatattactttgacaacgtgggccagggaaccctggtccaccgtctcctcagcctccaccaagggcccatcgtccttcccctggccgccctgctccaggngccacctccgagagcacacgccggccctgggctgccgttggtacgaacggacttacttcctatgtactactctgagcgggctggacgaggcgacagtagnnnnnnnnnnnnn

SEQ ID NO: 274085 - DNA, 658 bp, Homo sapiens
  misc_feature: GYAE6OF02GBIR7.48.34.D01.1.454.CMB.1.raw
  modified_base (217)..(217): a, c, t, g, unknown or other
  misc_feature (217)..(217): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggtttggggctgtgggctcaggagcagagctctgggaatctcaccatggcctggacccctctcctgcctccccctctcactttcngcacagtctctgacggcctcctctgagctgaacactacgccctacccgtcggtgtcgtagtccgtaccccgaaggaaccaaaccggccaaggtactccaaccgtgcttacgtggaacgactcggactacgttcgacctaaagttaaaatttttcgttaattcggtaaccaacgtagtaacgtacgacggaccaacggtcccctgttcccgtaggtaccttattttacgacggacggtaccgaccgaacgtacccgaccccttacgaggtacctccgtagaccgttacgttctacgtaggactacgactacgaggactagttccgaccttacgttagacttagtcgacggtcgggaccgagggtcggagtacgtaggtaacggtcgtaacgttacgttacgttcgtttacgaacgtaaccgacgtaaccgtaccgtagtacg

SEQ ID NO: 274086 - DNA, 516 bp, Homo sapiens
  misc_feature: GYAE6OF02IFNZY.48.34.D01.1.454.CMB.1.raw
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (410)..(410): a, c, t, g, unknown or other
  misc_feature (410)..(410): n is a, c, g, or t
  modified_base (447)..(447): a, c, t, g, unknown or other
  misc_feature (447)..(447): n is a, c, g, or t
  modified_base (462)..(462): a, c, t, g, unknown or other
  misc_feature (462)..(462): n is a, c, g, or t
  modified_base (475)..(475): a, c, t, g, unknown or other
  misc_feature (475)..(475): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtgctgttgtgtcaaatgatggacatgctgaatatgcagactccgtgaggggccattcgccttctccagagacaattccaagagcacggttcatctgcaaatgagcgccctgagcctgacgacacggctgtctatactgtgcgagngggctcgagttaacncgccgtcgggaggattattacgttgacacgtgggccagggaaccctggtcacgtctcctcancctcaccgaggcccagtccggtccttccccgtggccnccctgcctccaggcncaccgccagcgcncacggcgcccgtggcctggcctgtacaggtcctacttaccg

SEQ ID NO: 274087 - DNA, 648 bp, Homo sapiens
  misc_feature: GYAE6OF02IKJ3U.48.34.D01.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (403)..(403): a, c, t, g, unknown or other
  misc_feature (403)..(403): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggtttggggctgtgggctcaggaggcagagctctgggaatctcaccatggcctggacccctntcctgcctccccctctcactttcngcacntctctgacggcctcctctgacnctgaaccacagccaccgtggtntcaggtcncccaggacaacgccaggatcactnctcgtgganatcgcattcgacctaaaagttaaacgtttttgactttacggaaccaacgttgaacgtcgacggccacggcccttgtcctggtacctagtttacgnggtaacggacctaaccgacgtacccgaacccgttccgaaggtacccttcccgtacgacggttaacgtttcgtcgtaggtactacggtaacgcgaacgggacttagtccggtaccctacgtttagaaccttagtccgaaccggtcgggacccgagggttacggacggtagtaacgggttaacggttcgtaaccgttacgtttacgttcgttttacgaacctaacgtaccgaactccgtaagtaccg

SEQ ID NO: 274088 - DNA, 590 bp, Homo sapiens
  misc_feature: GYAE6OF02GG03C.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctgaatatgcagactccgtgaggggccattcgccttctccagagacaattccaagagcacggttcatctgacaaatgagccgccctgacgacctgacgacacggctgtctattactgtgcgagagggcgtcgtagttaacacggcgtcgggaggtatattacttgactaacgtcgggacacgggtacctggtccaccgtctcctcacgccctaccgaccgaacgggcctacgtccggtccttccccgcggcccgcccgtcgccctccgacggacgcccgacccgtccgacgtacgaccgtaacgaccggtcccggcccgtcgggtacccgtcggtacccggtcggtaccgaacggttacctaccgtttaacccg

SEQ ID NO: 274089 - DNA, 249 bp, Homo sapiens
  misc_feature: GYAE6OF02GO5L4.48.34.D01.1.454.CMB.1.raw
  modified_base (244)..(244): a, c, t, g, unknown or other
  misc_feature (244)..(244): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgcccccctcggtcactctgttccccaccctcctctatgtatactctgagcgggctgggcaaggcncatag

SEQ ID NO: 274090 - DNA, 202 bp, Homo sapiens
  misc_feature: GYAE6OF02H1VS6.48.34.D01.1.454.CMB.1.raw
  modified_base (202)..(202): a, c, t, g, unknown or other
  misc_feature (202)..(202): n is a, c, g, or t
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtggctgttgtgtacn

SEQ ID NO: 274091 - DNA, 723 bp, Homo sapiens
  misc_feature: GYAE6OF02HNKB3.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagccctctggattcacccttcaccaccttttcgtatgcactttggtccgccaggctccaggcaagggctggagtgggtggctgttgtgtcaaatgatggacatgctgaatatgcagacctccgtgacgggcctattccgccttctccagacgacaattaccgaagacgctaacggttcagtctgacaagtcgacgccgccgtaggacgtacctagaaccgacgtacggtctgtactattccgtgtacgcggaggtacgggtcgtaccggtaagttttaacgccgtaccgggtacggggacgggttactaagttttaccgtttaggtaaccgtaaccggtacggggtacccgtaacgggggtaacccttcggggtacctacccggttcctacccgtcgaaccggtccctacccgaaacccggtaaccgggtccctaacggtttccccggttacccgtttcccccggacgggtccctccccggtagtcccgtaccgacggacctccgtaacccgtcggaacgacggaccgaccggtaacggcccgggtacccgtacggggccttcgggtacccgttacgggtaccaaccggttaccgttacctttacccgg

SEQ ID NO: 274092 - DNA, 607 bp, Homo sapiens
  misc_feature: GYAE6OF02FH602.48.34.D01.1.454.CMB.1.raw
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattccgccttctcccagagacaattccaagagcacggttcatctgcaaatgagcgccctganacctgacgacacggctgtctattactgtgcgngagggcgtcgagtttacacgccgtcggggaggatatttacttgactaacgtggggccaggggaacccctggttccaaccgttcctcctcgacgcccgtccaaccgaacgggccccaagttccggtcccgtttaccccccgtgggtcccgccccgttagcccttcccgaaggacgcgaccccttcccggacgtacggcctaaccgaacgcccgggtcccctcggggccttcggcccgttggaccgtaacgggtaccttacccgtttaacccg

SEQ ID NO: 274093 - DNA, 553 bp, Homo sapiens
  misc_feature: GYAE6OF02IQKDD.48.34.D01.1.454.CMB.1.raw
  modified_base (328)..(328): a, c, t, g, unknown or other
  misc_feature (328)..(328): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccattcgccttctccagagacaattccaagagcacggttcatctgcaaatgagcgccctgagacctgacgacacggctgtctattacngtgcgagagggcgtcggagtttaacgacgtccgtcgggagggatattacttgacgacgtgggccagggaccctggtcaccgtctcctcgacgcctccaccaacgggcccagtccggtccttccccgtggacccggtccctcgcctcccgaggacgccacctccgagtacgctaccgaggccggcccgtcgggcctagcccgtggtcaacggtctaccttacccgg

SEQ ID NO: 274094 - DNA, 682 bp, Homo sapiens
  misc_feature: GYAE6OF02F5F9J.48.34.D01.1.454.CMB.1.raw
  modified_base (299)..(299): a, c, t, g, unknown or other
  misc_feature (299)..(299): n is a, c, g, or t
tcagagtatacatacacgaccggtgctcgatttagatcgtctgtgttggggtttgggggtgggctcaggaggcagagctctgggaatctcaccatggcctggacccctctcctgcctccccctcctcactttctgcacagtctctgaggcctcctctgagctgacacacgccacccgtcggtgtcagtcgtcccaggacaacggcagatcacctgctctggagatgcattgaccaaagtaaaattttgttattcggtaccaactgaagtcaggccaggcccctgtcctggtcatttagngaggacgacagccgaccctcgaggactcccgtgcgtaggttctcgtggactacgaactcgagggactacgttcggaccctacttgaactagtccacggtcggggaccctagggtaggaggtagtacgggtaaaggtgtaaccttacgtttcgttacgtttacctacgtaaccgaacgtaacctaccgtacgtacgtaactaacgtacgtaagtacggtacgtttacggtttaccggggtaacgggacggtaaccgaacggtcgtacggtacccgttccggtacggttaccgaaccggacccggtaaacgggtcccgttacccggtcccccgttcggtacccgtacccgttcccgttaccccgtttacccctcccctttacccg

SEQ ID NO: 274095 - DNA, 741 bp, Homo sapiens
  misc_feature: GYAE6OF02ISIS9.48.34.D01.1.454.CMB.1.raw
  modified_base (201)..(201): a, c, t, g, unknown or other
  misc_feature (201)..(201): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccaccttttcgtatgcactttgtccgccaggctccaggcaaggggctggagtgggtggctgtgtgtnaatgatggacatgctgaatatgcagacctccgtggacgggccgtattccgcttcaccgagacgacaaattccaaagacgcacggtctacgtactcgtagaactaaagtaggaccgcccgtaccgaggacgtaccgtacggaaaccggaccgtaccggtacgttacgttacgttaactttacgtggtacgggaacgggagggtaccggggtacccgttaccggttaaacggtttaaccgacccgggtaccgggtacggggttaaagtacgttttaagtttacgttacgaacccgtaacgggtccggggaccgtaaccgggtaccgttccggtacccgtaccgttccgtcccaccgtaccgtccccgtaaccgaaccgggtaccggtaccctacggttccccgttcccgttcccggccgcccgtcccgtcgtcccgacggtaccgcgtaccctacccgacggaacgacgtaccgaccgtccgggcccggtacccggtcggaccgtaccggtccggttaccgacgttaccgtaccgttaaccg

SEQ ID NO: 274096 - DNA, 737 bp, Homo sapiens
  misc_feature: GYAE6OF02GDJ6N.48.34.D01.1.454.CMB.1.raw
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggcctccaggcaaggggctggagtgggtggctgttgtgtcaaatgatggacatgctgaatntgcagactcgtaggagggcctattccgccttcncagagacattcaagngctacggttnatcagacaatgagccgcctagacgcctagaccgtacgaccggtcttggttaccttaagttacgtggttacggcggaaagggacggggttccgtacccggttaagttttaaaccgccggtacccgggtaacgggggaacggtaatttaacgttttaccgttaggaacgtaaccggtcggggacccgtaaacggggtaacccgtcggtacccgtacccgttcccgtacccgtaccgaccggtcccctaaccccggaacccggtaaccgggtacccctacggtttcccggtttacccccgttacccccggtggtacccccgtccccgttcgtccccttaccgggaaggaccctacccgtaacccgtaccggacgaacgtacccgaacggccgggccccgggtcccggtggtccccgtcgtcccggttacggtaaccgaacggttcccttacgttaccg

SEQ ID NO: 274097 - DNA, 253 bp, Homo sapiens
  misc_feature: GYAE6OF02GD10A.48.34.D01.1.454.CMB.1.raw
  modified_base (247)..(253): a, c, t, g, unknown or other
  misc_feature (247)..(253): n is a, c, g, or t
tcagagtatacatacacgaccggtgctcgatttagatcgtctgtgttgggtttgggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccaccctcctctatgtatactcgtgagcgggctgggcaaggcgcatagnnnnnnn

SEQ ID NO: 274098 - DNA, 849 bp, Homo sapiens
  misc_feature: GYAE6OF02HFO5F.48.34.D01.1.454.CMB.1.raw
tcagagtatacatacacgaccggtgctcgatttagatcgtctgtgttgggtttgggggtgggctcaggaggcagagctctgggaatctcaccatggcctggacccctctcctgcctccccctcctcactttctgcacagtctctgaggccctcctctgagctgacacacgcccacccgtcggtgtcagtcgtccccaggaccaaaccggccaggactccacctgctcgtgggatatcggactagttcgaacctaaaagttaaaatttttcgtttaagttacggttaaccctaaacgtaggtaaacgtccgacgggccctaccgggtcccccttggttccccgttaggtactaagtttttacgaggaacggaccaaccgtagcccggtaacccctcgaacggtacctcccgtggaccgttaggttccttcggtacggtactaccggtaaccgtcggaacgggtactaggtttacccgggaccttaaccgtttagaaccttacgtacccggtaaccgggtccggggggacccgtaagggggtacgggtaacggggtaacggtaagggtaaacgggttcgtaaaccggtttaccgtttacgtttaccggttttaccgtaaccaacggtaaaccggaacctaaccggtaacgtaagaacctaaacgttcgtaacgtcggtaccgttaacggtttaccgggacgggtaacgggtaacccgtaggtaccgtaccgggtacccggttccggtacgggtaccgaaccggtacccgaacgggtcccgtaccccggtcccccggttaccggtacccgttacccgttacccgttcccggttacccccctacccgttaccc

SEQ ID NO: 274099 - DNA, 682 bp, Homo sapiens
  misc_feature: GYAE6OF02FI9XI.48.34.D01.1.454.CMB.1.raw
  modified_base (346)..(346): a, c, t, g, unknown or other
  misc_feature (346)..(346): n is a, c, g, or t
tcagagtatacatacacgaccggtgctcgatttagatcgtctgtgttggggttgggggctgtgggctcaggaggcagagctctgggaatctcaccatggcctggacccctctcctgctccccctcctcactttctgcacagtctctgaggcctcctctgagctgacacagccaccctcggtgtcagtcgtccccaggacaaacggccaggactcacctgctctggagatgcattcgaccaaagtaaaatttgttattcggaccaactgaacgtcaacggccaggtccccctgtccgtggtctatttactgaggacgaccacgaccgaccctccgagggactcccgnggcgtaggttctcgtggtactaccgaactcgaagggtactacgttcggacctaccttgaacctagtccaacggtcggggcccgtagggtggtacggagtaggaagggtcgtaacttaaccgttcgttcgtttacctaaccgtaacgtaccgaaccgaccgtaagtacgaactaacgtcgtaacgtacggtaccgttacgttttccggggacggtacgggtaaccgtaacgtccgtacggtacccggttccggtacgggtccgaacggtcccgaaccgggtccgtacccggtcccccgtaccggtacccgacccgtttccgtcccgttacccccccg

SEQ ID NO: 274100 - DNA, 634 bp, Homo sapiens
  misc_feature: GYAE6OF02GAUMO.48.34.D01.1.454.CMB.1.raw
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtcccgccaggctccaggcaaggggctggagtgggtgctgttgtgtcaaatgatggacatgctgaatatgcagactccgtgaggggccattcgccttctccagagacaattccaagagcacggttcatctgacaaagtgagccgccctgagacctgacgacncggctgtactattactgtgcgaggacgggcgtaccgtagtttaaccncgtccggtggggaggtatagttacttgaactaacgtcggggaccacggggaacccttggtaccaccgtctccgtcgacgccctacgaccgaacgggtcccaagttccggtacctttccgacccgttcgggcccgtaccctcgtccgtacccgagggtaaccgtcccacccgttaccggaacggtcgaccgaccggacgggccccggttacccggtacgggtccttaccggcccggtttacgggtaccgtaaccgggtaccctttaaccccg

SEQ ID NO: 274101 - DNA, 668 bp, Homo sapiens
  misc_feature: GYAE6OF02GYO16.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagacctccgtaggaggggccattccgccttctccagagactaattccaagacgctacggttcatctgacaaatggacgccgccctaggacgacctggaccgacgacggcttcggtccttaattacgtggtcggcggtaaggacggggtccgtacggtagtttacgccgaccggtcgggtacggggaggtattacgtttacgttagaaccgtacggtcggggtaccgaccggggtaaccctcgggtacctaccgtcctccgtacgccgtccctacccgaccgaccggtccctacgttcccggtcccttaccccggtcggtcccgtacccgtcgtcctaccggacgaccgcctacccgtccgacggtaccgaccgtaccgacggcccggtccgtcgggtcctaccgggtcccgttacgggtaccgtaccggttaccgttaacccg

SEQ ID NO: 274102 - DNA, 666 bp, Homo sapiens
  misc_feature: GYAE6OF02FOIIL.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccactttcgtatgcactttgtccgccaggctccaggcaaggggctggagtgggtggctgttgtgtcaaatgatggacatgctgaatatgcagactccgtgaggggccattcgccttctccagagacaattccaagacgcacggttcatctgacaaatgacgccgccctgacgacctgacgacgacggctgtctattactgtgcgaggagggtcgtaccgtagtttaacgacggtccggtacggggaggtagttaacgtttacgtttaggaccgtaacggtcggggaccgaacggggtaacccgttcgggtaccgtacccggttcctacccgtccgaccgtccctacccgacccgaacgggtccccacgttccgggttacccgtttcccccgtcggtcccgtcccgtccgtccgtcccgaacggacgccgtacccgtaccggacgacgacccgaacggacggcccgggtaccccggtcgggtccgtcggccccgttgggtacccgtaacggttacccgttaccgttaaccccg

SEQ ID NO: 274103 - DNA, 775 bp, Homo sapiens
  misc_feature: GYAE6OF02IW4E7.48.34.D01.1.454.CMB.1.raw
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (750)..(750): a, c, t, g, unknown or other
  misc_feature (750)..(750): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggttggggctgtgggctcaggacggcagagctcgtgggaatcctcaccatcggcctcggacccctctcctcgcctccccctctcctactttcncgcanactctcgtacgacgccttcctctgacgtctcgacacacgccctaaccgtcggtcgtacacggtccgtacccgaagggaaccaaaaccgggcgaacggtacttaccaacccgttggaccgttcggtaggggaactacgtcggtaacctacgtttacggaaccgttaaaagtttaaaactttttcgttaaagtttacggtaacctaacgtacggaacgttacggacggcccgtaaccgtcccgttcgttacccggttagtacccgttaatttaacggtacgggtacggtaacccgaccggacggtacccgaaccccgtaccggtaacgggtccctccgggtacggtacgttacggttcctacggacggtaaccttacggaactccggaaaggtacgtacgttacggtacctaaccgttagtacctacgttaccgtaacggccggggactaagggcggtagaacggttacggaaggttacccaacttttaccggttactttacggtttaaccgacccggtaanaacccggtacctacgtaacgtaacg

SEQ ID NO: 274104 - DNA, 250 bp, Homo sapiens
  misc_feature: GYAE6OF02G6FWT.48.34.D01.1.454.CMB.1.raw
  modified_base (244)..(250): a, c, t, g, unknown or other
  misc_feature (244)..(250): n is a, c, g, or t
tcagagtatacatacacgaccggtgctcgatttagatcgtctgtgttgggtttgggggtgtggtggtctccactcccgccttgacgaggctgattactactgtcagtctttgataacaacaatcacgtggtcttcggcggaggaccagcctgaccgtcctaggtcagcccaaggctcgccccctggtcactctgttcccaccctcctctatgtatactctgagcgggctggcaaggcgcatagnnnnnnn

SEQ ID NO: 274105 - DNA, 687 bp, Homo sapiens
  misc_feature: GYAE6OF02IDJHW.48.34.D01.1.454.CMB.1.raw
  modified_base (329)..(329): a, c, t, g, unknown or other
  misc_feature (329)..(329): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctactttgtcccgccaggcctccgaggcgaagggggtctgggagttggggtgtctgttgtgtacaaagtgatcggacatgctgaatatgcagacctccggtggaccggggctacgttccgtccttcctaccgaggacgtaactaacttccgaaagtacgtccgtaacggttcacgttacngaactaaagtcggacgccgccgtgaacgtaccgtcgaccgtacgaccggcttcgttactacttacgtgtcggcgaggcgggtctaccgtagttaacgaccgtcggtacgggagtattacttacgttgaactacggtcgggacgacgggtaccctgggtaccctccgttacctccgactaccggtccctaccgaccgtaccggcctacgtcccggttcccgttccccgtaccggtcccgacccgtcgcccgtacgtacggacctcccgtaacgccggtacgaccgtccgtacgccggtaccgggtcccgtaggtaccgtccggtccgtacgggtacgtaacggtacctaccgttacccg

SEQ ID NO: 274106 - DNA, 640 bp, Homo sapiens
  misc_feature: GYAE6OF02GOC2X.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtggaggggccattcgccttctccagacgacaacttccaagagcgacggttcatctagacaaatggacgccgcccgtgacgaccgtgaccgacgacggctgtcttattacgtgtgcgaggcgggcgtacgtaagtttaacgacggtccggtaggggaggtattacgtttacgtttcgaacgtaacggtcggggaccaacggggtaaccctcggtaccacccgttcctccctacgacgtccctacccgaaccggacggcccctagttcccggttacccttccccgtcggccccgtcccgtcgtcccgtaccgacggtaccgcctacccgccgacgacgcgaaccgaccggcccggtcccgtcgggcctcggtacccgttgggacctaacgggtacccttcgtttacccc

SEQ ID NO: 274107 - DNA, 257 bp, Homo sapiens
  misc_feature: GYAE6OF02FKK86.48.34.D01.1.454.CMB.1.raw
  modified_base (244)..(257): a, c, t, g, unknown or other
  misc_feature (244)..(257): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccgccctcctctatgtatactctgagcgggctggcaaggcgcatgnnnnnnnnnnnnnn

SEQ ID NO: 274108 - DNA, 644 bp, Homo sapiens
  misc_feature: GYAE6OF02FYZAR.48.34.D01.1.454.CMB.1.raw
tcagagtatacatacacgaccggtgctcgatttagatcgtctgtgttggggttgggggctgtgggctcaggaggcagagctctgggaatctcaccatggcctggacccctctcctgctccccctcctcactttctgcacagtctctgaggcctcctctgagctgacacagcccaccctcggtgtcagtcgtccccaggacaaacggccaggatcacctgctcgtggagatgcattgaccaaagtaaaattttgttattggtaaccaactgaagtcaggccacggcccctgtccctggtctatttatgaggacgaccagccgaccctcaggactcccgtgcgtaggttctcgtggtactcgaactcgaagggctagttcggaccctacgttgactatcgacggtcggggaccgtagggtagggaggtagtaggtaaggtcgtaacttacgttcgttcgtttccgtactaacgtacgaaccaccgtagtacgaactaactctacgtcgtacgttacgttttcgggacgggacgggaaccgacgcgtacggtacccgttccggtcgggtaccgaccggacccggtacggtcccgtcccggtcccccgttaccggtaccctacccgttcccgttcccgttaccccccg

SEQ ID NO: 274109 - DNA, 697 bp, Homo sapiens
  misc_feature: GYAE6OF02GNGPB.48.34.D01.1.454.CMB.1.raw
  modified_base (252)..(252): a, c, t, g, unknown or other
  misc_feature (252)..(252): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactcgtgaggggccattcgccttcnccagacgacaattccaagagcacggttcatctgacaaatgagccgcctgacgacctgacgacgacggctgtactattacgtgtgacgaggacgggcgtaccggtaagtttaaaccgacggtaccgggtacggggaagggtatttacgtttacgtttaggaaccgtaacggttggggacccgtaacggggtaaccccgtggtaccacccggttctcccgtacgacgtaccctacccgaaccgtaaccgggccctacgttcccgggttccctttcccccggcgggtccccgtaccccgtggtacccttcccggaacgggtaccacccgtacccgtaccgggacgaccgaccgaaccggaacgggccccggtaccccggttcggggtcccttccgggtcccggttaccgggtaaccgtaaccgggttaccctttacccgtttaacccg

SEQ ID NO: 274110 - DNA, 570 bp, Homo sapiens
  misc_feature: GYAE6OF02FUTXH.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaaagacgcacggttcatctgacaaatgagccgccctgacgacctgacgacacggctgtctattactgtgcgagagggccgtccgagtttaacacgccgtcgggagggatatttacttgacaacgtgggccagggacctggtccaccgtctcctcacgcctccaccgacgggcccagtccggtcccttccccgcgccgcccgtgcctccgacggaccgccgacccgtccgacgacgccgaaccgacggcccggcccgtcgggcctccggcccttacgggtaccaacgggtaccttacttcccg

SEQ ID NO: 274111 - DNA, 740 bp, Homo sapiens
  misc_feature: GYAE6OF02I9Q2H.48.34.D01.1.454.CMB.1.raw
  modified_base (273)..(273): a, c, t, g, unknown or other
  misc_feature (273)..(273): n is a, c, g, or t
  modified_base (674)..(674): a, c, t, g, unknown or other
  misc_feature (674)..(674): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtcccgccaggctccaggcaaggggctggagtgggtgctgttgtgtcaaatgatggacagtgctgaatatgcagactccgtggcgggcattcgccttcacagagacattaccaagacncgtacggtcatctgactaagtcgacggccgtcccgtagacgtacctacgacggaccgaccggtcttggttaccttaacgttacgttcggtacgtcgggaacggtacggggtccggttaaccggtaacgttttaaaccggaccggtaccccgggtacgggtaacggggtactttacgttttaccgtttacgaaccgtaaccgggtcgggggaccgtaaccgggtaacccgtcgggtaccgtacccggttaccgtacccctaccgaccgttaccccgaacccgaacccggtacccggtacccgtaaccggttcccgggttacccccgtttacccccgggtcggtcccgtaccccgtcggtcccgtaccggtaacggacgtcccaccgttccgacggacaccgngaccggccggtacccgtgggtacctcggtccgtaccgggtactaccggtaaccttcccgttaaccg

SEQ ID NO: 274112 - DNA, 882 bp, Homo sapiens
  misc_feature: GYAE6OF02ILVAJ.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcacctttcaccacctttcgtatgcacttttgtccgccaggctccaggcaaggggctggagtgggtggctgttgtgtcaaatgatggacatgctgaatatgacagacctccggtggacggggccgtacgttccgtccctttcctaccgagaacggaacctaaatttacccaaaggacgaccgtaaccgggtttcacttaccgttcgaacgtaaaaacttgggaaccggcccggacccccgttaggaaaccggtaccccttacgggaaccgaacccggtaccgggtaccgtttacggttcctttaaacgttttacgtggtttacgggacgggtaagggacggggtccggtttacccggttaacggttttaaacccggaccgggtaccggggttacgggggtaaagggttacttttaacgtttttaaccgtttaggaaacccgttaacgggtccgggggaacccgtaaacggggtaacccccgttgggttaccctacccggttccgtcccgttacgaccgtccccttaacccgaacccggtaaccgggtaccccctaggtttccccgggtttaccccttcccccggtacggtccccgtccccgttcggacccgttacccgaacgggtacaccccgtaacccgtaccgaccggtaccgaccgaaccggtacccgggtcccggtccccggtacgggtcccgttccggtccccggtttaaccgggaccggtaaacccgggttccctttaacccggtttaccg

SEQ ID NO: 274113 - DNA, 258 bp, Homo sapiens
  misc_feature: GYAE6OF02ISPNI.48.34.D01.1.454.CMB.1.raw
  modified_base (247)..(258): a, c, t, g, unknown or other
  misc_feature (247)..(258): n is a, c, g, or t
tcagagtatacatacacgaccggtgctcgatttagatcgtctgtgttgggtttggggggtgtggtggtctccactcccgccttgacgaggctgattactactgtcagttctttgataacaacaatcacgtggtcttcggcggagggaccagcctgaccgtcctaggtcagcccaaggctgccccctggtcactctcgttcccgccctcctctatgtatactctgagccggctggcaaggcgcatagnnnnnnnnnnnn

SEQ ID NO: 274114 - DNA, 779 bp, Homo sapiens
  misc_feature: GYAE6OF02IL1RN.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgctactttgtccgccaggctccaggcaaggggctggagtgggtgctgttgtgtcaaatgatggacatgctagaatatgcagacctccggtggacgggccgtattccgccttctccagtacgaactaacttaccgaagacgcctaacggttcatctgacaaatgacgccgccctgacgacctgaccgaacacggtctgtactagttacttgtcggacgtagggacgggtcgttaccggtacgtttaaaccgacggtcccggggtacggggaacgggtatttaacgtttaccgttttagaaccgtaaccggtacggggaccgtaaaccgggtacccgttacggtaccctacccgttcctcccgtaccgtaccgtaccccttaccccgaaacccggtaaaccggggccccctaaccggttcccggtttccccgtttaccccccgggtccgggtaccccggtccccgttccgggtcccgtaccccggaacggggtaccgaccccgtaccccgttacccggaggtacccgacccggaacccggtacccgggaccccgggtccccggtacgggtcccgttaccggtcccggttacgggttaacccggaacccggttaccccgttacccgtttcccccg

SEQ ID NO: 274115 - DNA, 671 bp, Homo sapiens
  misc_feature: GYAE6OF02INZRM.48.34.D01.1.454.CMB.1.raw
  modified_base (198)..(198): a, c, t, g, unknown or other
  misc_feature (198)..(198): n is a, c, g, or t
  modified_base (331)..(331): a, c, t, g, unknown or other
  misc_feature (331)..(331): n is a, c, g, or t
  modified_base (391)..(391): a, c, t, g, unknown or other
  misc_feature (391)..(391): n is a, c, g, or t
tcagagtatacatacacgaccggtgctcgatttagatcgtctgtgttgggtttggggtctgggagacgagcccagcactggaagtcgccggtgtttccattcggtgctcagcactgaacacagaggactcaccatggagtttgggctgaacttgggttttcctcgttgcttcttttaagagatgtccagtgtcgggtncgagttggtggaggtcgggggggaggtggttggtccaggtccgtaggggaacgtccctgacactcgtcctgcgcagcctcgtggattccaccttccacctacctttcgtatgcctactttcgccgccaggtcnccgaggcgaggggctggaggtgggtggcttggttgtgactaagtgagtggactagtacgntagtaatatcgacagtaccgtcggtagggacgggtcgtagttcccgtcctttctacgacgaacgaacctaacgttaccgaaaggtcgtaccgttacggttacacgttacgtcgaacgtaagtacggaccgtacccgtacctacggaccgtaccgtacggtaaccgacggtaccgctttacgttacttcgttaaccgtggttacggacgggtacgggtacgggttacccgtacggttaaccggtttaccggaccgggtaccgggggtaggacgggtttaac

SEQ ID NO: 274116 - DNA, 746 bp, Homo sapiens
  misc_feature: GYAE6OF02I5P1P.48.34.D01.1.454.CMB.1.raw
  modified_base (361)..(361): a, c, t, g, unknown or other
  misc_feature (361)..(361): n is a, c, g, or t
tcagagtatacatacacgaccggtgctcgatttagatcgtctgtgttgggtttgggggggctcaggaggcagagctctgggaatctcaccatggcctggacccctctcctgctccccctcctcactttctgcacagtctctgaggcctcctctgagctgacacagcccaccctcggtgtcagtcgtccccaggacaaacggccaggatccacctgctcgtggagatgcattcgacctaaaggtaaaattttgtattcggtaaccaattgaagtcacgccacggcccctgtccctggtctagtttagtggaacggtaccgaaccgacgtcccggtaccccgtaccgaagggaccttccccgngaccggtaggtttcctacgtcggtaactaccgtaactacggaacggggtactaacggttccggtaccctaaccgttcgtaacctacgtacccgtacgggttccgggggaccctaagggggtaggtaacggtaagtacgggtaaacggttacgtaaccttaccgtttcgtttacgtttacctaataaaccgacgtaacctaacgtacggttaaccgaaacgtaactacctaagtaccgtacggtttacgtttaccggggaacggtacgggaaccgtacgacgttaccggaccgtccgtaggtcccgaacgtcccggaaccggtccgtccccggacccgttccgttccgacctttccgtacccttacccctacccgttcccttaacg

SEQ ID NO: 274117 - DNA, 716 bp, Homo sapiens
  misc_feature: GYAE6OF02HH6X1.48.34.D01.1.454.CMB.1.raw
  modified_base (306)..(306): a, c, t, g, unknown or other
  misc_feature (306)..(306): n is a, c, g, or t
  modified_base (578)..(578): a, c, t, g, unknown or other
  misc_feature (578)..(578): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctacttttgtccgccaggcctccgaggcaaggggctggagtgggtgctgttgtgtacaaatgatggacatgctgaatatgcagactccggtggacggggcctattccgccttctaccagacgaactaacttaccgaagacgcgtaccggttcactcngacaagtgcgccgccctgacgtctgaccgactaccggtctgttcgtacttacgtgtacggacggaggtcgggtccgttaccggttaacgttttaaccgaccgggtccgggtacggggtacggtaactttagttttaccgttacggacgttaaccgggtcggggtaacccgtacgggtaaccccgttggtacccgtaccgtcctcccgtacgaccgtcccgtacgaccgaccgggcccttcgtcccgttccgttcccgtacggcccgtacccngtcccgtcgacggtaccgcctacccggtccgacggtacgacccggtacggacccggtcccggggtaccgtccggggttcccgccggttaccgggttacggtaacccggtaaccggtacccttttaccccgttccccgg

SEQ ID NO: 274118 - DNA, 579 bp, Homo sapiens
  misc_feature: GYAE6OF02GDHBU.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccaccttttcgtatgcactttgtccgccaggctccaggcaaggggctggagtgggtggctgttgtgtcaaatgatggacatgctgaatatgcagactccgtggacggggcctattccgccttctccagagacaattccaagagcacggttcatctgacaaatgagccgcctgagacctgacgacgcggtctgtctattactgtgacgagacgggcgtcgagtttaacacggtccgtgggaggtatacgtttacgttgacaacgtggggccaggggtaaccctggtccaccgtcctccgtcacgtccaccaccgacggccctacgtccggtccttccccgtggcccgtcccgtcgcctaccgacgacgcctacccgtcgacgcgaccgacgacggccggtccgtggccgtcgccgttcggtacgaacggtaccttaccgttacccg

SEQ ID NO: 274119 - DNA, 744 bp, Homo sapiens
  misc_feature: GYAE6OF02IK74L.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaagggctggagtgggtgctgttgtgtcaaatgatggacatgctagaatatgcagactccgtggacggggcagttccgccttcctaccagacgacaattcaagagcgacgtcatctagacaaatgacgccgtcctgacgaccgtagaccgacgaccggtctacgttactacttacgtgttcgacgtaggacgggtcgtaccgttacggtttaaaccgaccggtaccgggtacggggtaacgggtacgttaacgtttacgtttacggaacgtaccgggtacggggtacccgaacgggtaaccccgtcggttacccgtaccgttccgtcccacgtaccgacccgtacccgaaccggaccggacccgtacgtacccggttccccgttccccgtaccgggtacccgtcccccgttacgtcccgtacccgaacggtacccgtacccgtacccgttacccggaccgaaccgacccggtaacccggaacccggtcccgggtaccccggttcgggaccccgttcggtacccggtttaccgggtaacccggaaccggttacccgtttacccgtttaacccgg

SEQ ID NO: 274120 - DNA, 589 bp, Homo sapiens
  misc_feature: GYAE6OF02HECJG.48.34.D01.1.454.CMB.1.raw
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtggaggggccattcgccttctccagagactaattccaagagcacggttcatctgacaaatgacgcgccctgacgacctgacgacacggctgtctattactgtgcgaggcgggtcgtaccgtagtttaaccgacgtccggtacgggaggtacttagtttacgtttgacgtaacggtcggggaccacgggtaaccctggtccaccgttcctcctcacgtccctaccgaaccgtacggtcctacgtccgttcccttccccgnggcccncccgtgcctaccgacggaccgtaccgtccgagcgcacggcgccggtccgtcggctgtccgtacggtaccgaacggtaccttacgtactacg

SEQ ID NO: 274121 - DNA, 832 bp, Homo sapiens
  misc_feature: GYAE6OF02F7RU4.48.34.D01.1.454.CMB.1.raw
  modified_base (276)..(276): a, c, t, g, unknown or other
  misc_feature (276)..(276): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctagaatatgcagactccgtggaggggccgattcgccttcctccagagacaattccaaagngctacggttcactctgacaaagtgacgccgccctagacgtacctcgaccgacgaccggtctagtctacttacgtgtgacggagggacgggtccggttaccgtaacgttttaaccgaccgggtacccgggttacgggggagggtaattacgttttacgttttacggaaccgtaacgggttacggggaccccgtaaacgggggtaaccccgttacgggttacccgtaccccggttcccgttaccccgtaccgaacccggtcccccgtttaaccccaaacccccggggtaaacccggggtccccctaaccgggtttacccccgggtttaccccccgttttaccccccgggtccggggtacccccgtcccccgttaccggtaccccggttacccggaaaccggggtaccgtaccccgtacccccgttaccgggacgacccggtaacccgaaccgacccggggtaccccggggtcccccggttacgggggtcccttacccgggtccccggtttaccggggtaacccggtaaccgggttaacccctttaccctttaacccgg

SEQ ID NO: 274122 - DNA, 680 bp, Homo sapiens
  misc_feature: GYAE6OF02H0LJ9.48.34.D01.1.454.CMB.1.raw
  modified_base (254)..(254): a, c, t, g, unknown or other
  misc_feature (254)..(254): n is a, c, g, or t
  modified_base (305)..(305): a, c, t, g, unknown or other
  misc_feature (305)..(305): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgctactttcgtccgccaggcctccaggcaaggggctggagtgggtgctgtgtgtcaaatgatggacatgctgaatatgcagactcgtgacgggctattcgccttcncagagacatccaagagctacggtcatctagactaaatcgacgcgcctgacnctagacgacacgctagtctaattcgtgtcgagaggaggtaccgttaccgtaagttaacgcgtccggtagggacggtacttacgtttacgttacggaacgtacggtacgggaccgtaacggtaacccgtggtacccaccggttcctccgtacgaccgtccctaccgaaccgaccgggtaccctacgtcccgttacccgttccccgttcggcccgtccccgtacgcccttaccgacggtaccgtcccgtaacccgtccggacgtacccgaccggaacccggaccggtccccggggtccccgttacggggccctttaccgggcccggtttaacgggtaccccgttaaacgggttaccccgtttaacccgtttacccgg

SEQ ID NO: 274123 - DNA, 799 bp, Homo sapiens
  misc_feature: GYAE6OF02JEXUD.48.34.D01.1.454.CMB.1.raw
  modified_base (231)..(231): a, c, t, g, unknown or other
  misc_feature (231)..(231): n is a, c, g, or t
tcagagtatacatacacgaccggtgctcgatttagatcgtctgtgttggggttgggggctgtgggctcaggaggcagagctctgggaatctcaccatggcctggacccctctcctgcctcccccctcctcactttctgcacagtctctgacggcctctctgagctgacacacgcccaccctcggtgtcaggtcgtcccaaggacaaacggccaggatcactgctcgtgganatgctagttcgaacctaaagttaaaacttttggttaattacggtaaccctaaagttagtaaacggtccgaggtacccaaccgggtcccccttaggtccccgttacggttacttaacgtttttaacgacggaacgggaaaccgtacccgaacggtcccgtaacccccgttaccgaacgggtaacccttccccggtggtaaccgggttaacggtttcctaggtacgggtaacctacggtaaacctcggaagggaacctagttcgggaccccttacgtagtaactactaccggtaaccggtccggggtacccgtagggtacggtaagggtaggtaagggtaacggtacgtaacgttaccgttacgtttacgtttactaacgtaaacgtacgtaacgtaaccgtaaggtaccgaacgtaactacgtagttacgtaccggttaacggttttacgggacgggtaacggaaccgtaacgtaccggtaccgtaccgtccggtacgggtaccacggtacccgacggttaccgtccgtaccccgtccgttacgtcccgttaccgtacccgttaccccg

SEQ ID NO: 274124 - DNA, 249 bp, Homo sapiens
  misc_feature: GYAE6OF02ISI0N.48.34.D01.1.454.CMB.1.raw
  modified_base (244)..(249): a, c, t, g, unknown or other
  misc_feature (244)..(249): n is a, c, g, or t
tcagagtatacatacacgaccggtgctcgatttagatcgtctgtgttgggtttgggggtgtggtggtctccactcccgccttgacgaggctgattactactgtcagtcttttgataacaacaatcacgtggtcttcggcggaggaccagcctgaccgtcctaggtcagcccaaggctgccccctggtcactctgttccccgccctcctctatgtatactctgagcggctggcaaggcgcatagnnnnnn

SEQ ID NO: 274125 - DNA, 706 bp, Homo sapiens
  misc_feature: GYAE6OF02JZL9H.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaagggctggagtgggtgctgttgtgtcaatgatggacatgctagaatatgcagactccggtaggacggggccgagttccgtccttctaccaggacgactaattaccgaagacgaccgtacggttcatcgtgacaaagtcgaacgtccgaccgttggaacgtaccgtacgtaccggaccgacggtctgttactattacgtgtacgcgaggacggtacgtacgtaagttacgacggtccggtacgggagtatagtttactagacgtacggtacgggtaccgtaacgggtaccgttcggtaaaaccgtccgttacctcccgtaccgaccgtacccgtacccgaaccggtaccggacccgtaccgtacccgttcccgttccccgtaccgtcccgtcccgtccgtaccgtccgaccggaccgtacccgtacccgtaccggacgtaccggtaccgaccggaccggtcccggtacccggtcggtaccgtcccggttcggacccggttaaccggtaacggttacccgttaccgttaacccgg

SEQ ID NO: 274126 - DNA, 961 bp, Homo sapiens
  misc_feature: GYAE6OF02ILQH0.48.34.D01.1.454.CMB.1.raw
  modified_base (231)..(231): a, c, t, g, unknown or other
  misc_feature (231)..(231): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattccaccttcaccacctttcgtatgctactttgtccgtccaggctccaggcgaagggctggagtgggtggctgttgtgtcaaatgagtgacatgctaggattacgtnacgtacgacctccggtggacggggcctacgttccgccctttcgtaccgtaagtacgtaaccgtaaccttaccgaaaggtcgacccgtaacggtttcctacgttaccgtcggtaacctaaaaggtcggaacggtccccgtacccgttaggaaccggaccccgttacgaacccggtaccgtaacggtccgttaccgttacgttaatttacccggtcggttaacggacccgggttaagggaccgggggtaccctttacccgggttaaaacggttttaaccgacccgggtacccgggggtacggggtaaacggggttaactttaaccgttttaagtttaccggaaccgtttaaacccggggtttaacgggggacccccgttaaacccggggttacccggttacccgggttaacctaacccccggttccgttaacccgttccggttaacccggtaccccgttaaccccggaacccggtaaacccggggtttcccccgtagggtttaaccccccgggtttcccttcccccggggtaacggttcccccgtacccgttcggtaccccgtacggtaaccgggtcccgtaaacccccgttaacccgcccgggaacggttaccggaaccgtaacccgggtaccccgggacccggggttccccggttaaccgggcctttacccgggtaaccccgtttgggaaacccggttacggttaaccccccgtttgttttacccccggg

SEQ ID NO: 274127 - DNA, 778 bp, Homo sapiens
  misc_feature: GYAE6OF02G98N2.48.34.D01.1.454.CMB.1.raw
tcagagtatacatacacgaccggtgctcgatttagatcgtctgtgttgggtttgggggtgggctcaggaggcagagctctgggaatctcaccatggccctggacccctctcctgcctcccccctcctcacctttctgcacagtcctctgaggcctctctgagctagacacacgtccccacccgtggtcgtccaggttccgtacccccgaagggaaccaaaaccggccaagggactacccaaccgtggccttacgtggaacgactggacctagttcgaccgtaaaagttaaaacgttttgtaacgttacggtaacctaaacgtcggtaaaggtccgtaacggacccgaccggtccccgttaggttcggttcggtacgtaccgttccggtaaggaaagtaactaaaaccggaccgggacccggcccctacggtaacggtcctaaccgtcccggtaaggaccggtaccgttaactttcccgtacggttcggtaccctaaccgtaaccgtacggttaacgggaacctccggtaccgaacccctaacccgtacgaaccgacgtaccgggaccgggtaccgtacggtcgtagacgtggacgtcgtagactcgtacgcgtcggacggtacggtcgtacggacgtaacacgacctaggtacggtcgggttaaccgggttaccgggggacggggtaccaggtccgtaacgggccgggtacgtcggtacgaccgtccggacgtccgtccgaccctcgcttaccgccgttcccgtcccgtccttcctcg

SEQ ID NO: 274128 - DNA, 585 bp, Homo sapiens
  misc_feature: GYAE6OF02I8YPD.48.34.D01.1.454.CMB.1.raw
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagacctccgtggaggggccagttccgccttctccaggacgaactaacttaccaagacgcctacggttacatctgacaaatgacgccgcctgacgacctgacgacacggtctgtctattactgtgcgagacggcgtaccgaagtttacgaccgccggtacgggaggtatagtttacttagactaacggtcgggacacgggacctggtccacgtcctccgtcacgtcctccaaccgacggccctacgtcccggtcccttcccgtggcccgtcctcgcccttcgnggaccnccctaccgtcccgagccgaccgacgcgccggacccgtggcctcggccttcggacgacggtccttaccttccg

SEQ ID NO: 274129 - DNA, 915 bp, Homo sapiens
  misc_feature: GYAE6OF02JPHWX.48.34.D01.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagagtatacatacacgaccggtgctcgatttagatcgtctgtgttgggtgcagttggtggaggtcggggggaggtgtggtccagcctgggaagtccctgacactgtcctgcgcagcctctggattcaccttcaccctacctttcgtatgctactttgtccgccaggcctccaggcgaaggggctggaggtcgggnggtcttgttgtgtacaaatgtatggacactgctagtaattatgaccaagtactccggtaggtacgggccgttattccggtcctttccncctacggaacgaacgtaacttaccgaaggtaacgtcccgtaacgggtttaccacgttaccgttcggaaacctaaacgtagggttaaccgacccggtccccgtaagtaaccggaacccggttaaccgaacggaacccgtaccggtaccgtttacgttaaccgttacgtttaaccgtaggtccggtacggaaggacggtacccggttaacgtaaacggtttaaaccgaccgggtacccggggtaacggggtaaggttaccgttaacgttttaccgttaacggtaacggtaaccgggttaccgggacccggtaaaccggggtaaccccggttaccgggttaccgtacccggttacccgttacccgtacccggacccggttaacccgtaccccgtaaaccccggtaacccgggaccccgtaaccgttccccgggtttaccccgttcccccgggttccggtccccgtacccgttcccgtacccgttacccgtacgtaacccggtaacccgtaccccgtaccgggtaccgtaaccgcccggaaccggtaaccgggtcccggtcccccggtacgggtcccgttaccggttccggaccccggtaagtaaccccgggttaaccttcccgttaaccccgg

SEQ ID NO: 274130 - DNA, 658 bp, Homo sapiens
  misc_feature: GYAE6OF02JOQQH.48.34.D01.1.454.CMB.1.raw
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
  modified_base (624)..(624): a, c, t, g, unknown or other
  misc_feature (624)..(624): n is a, c, g, or t
tcagagtatacatacacgaccggtgctcgatttagatcgtctgtgttgggtttgggggaagaggaagactgacggtcctgccacaggaggtgtggtccagcctgggaagtccctgacactgtcctgcgcagcctctggattccaccttcaccaccttttcgtatgctactttgtccgccaggctccaggcaaggggctggagtgggtgctgttgtgtcaaatgatggacagtgctgaatctgcagactcggtgaggggccattccgccttctaccagagactattccaaagcgctacggttcagttcngcaaagtggacnccgcctagacgtacctagaccacgcggactgtaccttaagttctgtcgcggaagtggggtccttcgaaagtttaacgccggtcggtagggaagggtactttacgttaccgtttagaaccgtaaacggttcggggaaccctacggggtaacccttgggaccttaccggttctcccgtcaacgtcccgtaccaaaccggaacgggtcccctaacggttccggttccccgttaccccgttcgggtacccgtccccttgtcccgtccgacgggtccgaccgtcccgtcgaacgaaccgccgaaaccgnggtcccggccgtcggccttcgggtcccgtacggg

SEQ ID NO: 274131 - DNA, 658 bp, Homo sapiens
  misc_feature: GYAE6OF02GNVOF.48.34.D01.1.454.CMB.1.raw
  modified_base (511)..(511): a, c, t, g, unknown or other
  misc_feature (511)..(511): n is a, c, g, or t
  modified_base (541)..(541): a, c, t, g, unknown or other
  misc_feature (541)..(541): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaagggctggagtgggtgctgttgtgtcaaagtgatggacatgctgaatatgcagactccgtggacgggccattcgccttctccagagacaattccaagacgcgacggttcatctgactaaatgagccgccctagacgacctgacgacacgctgtctattacgtgtgacgtaggcgggtccgtacgtacgtttaacgaccggtccggtcggggaaggtacttacgtttacgttacgacgtaacggtcggggaccgaacgggtaccctggtcctaccgtcctaccgtacgacgtccctaccgaccgacgggtaccctcgtacccggttcccgttcccccgnggtcccgtcctccgtccgtccgacggtacncccgtacccgtacggaccgtacgaccgtaaccggccggtcccgggtcccgttaccgggccgttaccgggtcccgtttaccgggaacccgtaacggtaccctttacccggtttacccg

SEQ ID NO: 274132 - DNA, 779 bp, Homo sapiens
  misc_feature: GYAE6OF02HJC1R.48.34.D01.1.454.CMB.1.raw
  modified_base (161)..(161): a, c, t, g, unknown or other
  misc_feature (161)..(161): n is a, c, g, or t
  modified_base (731)..(731): a, c, t, g, unknown or other
  misc_feature (731)..(731): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggtttggggctgtgggctcaggaggcagngtctctgggaatctcacatgcctcgaccctctctcgcctcccctctactactttcagcacgtacgttcttctggacggtccttctctagacgtctagaccaacgtacgcccctaaccgtcggtacgtactacggtaccgtaccccgaaggtaacccgaaacgtccgaagtaccttacaacccgttgaccgttacgtacggaacttacgtccgaccgtaagttaccggtaacctaaaaacggtttaaaacgtttttcgttaacgtaccggttaaacctaaaacggtcgttaaaccggtacggtaaccggtacccgtaccggttaccccgtttaggttaccccgtaaggttaccgtttaaacgttttaacggaccggtaacggtaaacccgacccgtaacgggtccccgtaaacccgtacccgtaagggttacccttaccggtgtaaccggtacggtttaccacggttacgaccgttaacgactacggtaggtaccttaggtacccgtcctaagttccgaccttaagccgttaaggaccggttccgaagggtagtacgtagtagaaccggtntaaaccttcgtcgttacgttaccacggaactacgtacgtaactgtaac

SEQ ID NO: 274133 - DNA, 573 bp, Homo sapiens
  misc_feature: GYAE6OF02FI9I5.48.34.D01.1.454.CMB.1.raw
  modified_base (424)..(424): a, c, t, g, unknown or other
  misc_feature (424)..(424): n is a, c, g, or t
  modified_base (461)..(461): a, c, t, g, unknown or other
  misc_feature (461)..(461): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagacgcacggttcatctgacaaatgagccgccctgacgacctgacgacacggctgtctattactgtgcgagagggcgtccgtagtttaacgacgccggtcgggagggattagtttacttgacacgtggggccagggaccctggtcaccgtctccncacgccctccacacgggcccagtccgtccttccccgnggcccgccctcgccttaccgacggacgccacccgtccgacgacgaccgacgacgcccgggcccgtacggggcctcggcccgtaggtaccgaacgggtaccttacgttacccg

SEQ ID NO: 274134 - DNA, 670 bp, Homo sapiens
  misc_feature: GYAE6OF02HW0VW.48.34.D01.1.454.CMB.1.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
  modified_base (579)..(579): a, c, t, g, unknown or other
  misc_feature (579)..(579): n is a, c, g, or t
  modified_base (589)..(589): a, c, t, g, unknown or other
  misc_feature (589)..(589): n is a, c, g, or t
  modified_base (603)..(603): a, c, t, g, unknown or other
  misc_feature (603)..(603): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcacccttcaccaccttttcgtatgcactttgtccgccaggctccaggcaaggggctgggagtgggtggctggttgtgtacaaatgatggaacatgctgaatatgacagacctcgngacggggcattcgccttcnccagagactaattccaagacgcaacggttcatctgacaaagtggacgccgtcctanacgacctgacgacgacggtctgttacttatactaggcgtacggacggtaggggtccgttaccggtaagttttaaaccgaccgggtaccgggtaacggggtagggtactttaacggttttacgtttacggaacgtaaaccggtcgggggacccgtaaacggggtaacccctgggtttaccaacccggttctcccgtaccgaccgtaccctaccgaaccgaaccgggcctacgtccggttacctccccgtggccctccgtgaccnccgaggtacnccgtaccctcgganacgccaacggaccggccggtcccgtagggcctacggcccgttaggaccggtaacgtaccttactacg

SEQ ID NO: 274135 - DNA, 476 bp, Homo sapiens
  misc_feature: GYAE6OF02GN80Q.48.34.D01.1.454.CMB.1.raw
  modified_base (157)..(157): a, c, t, g, unknown or other
  misc_feature (157)..(157): n is a, c, g, or t
  modified_base (305)..(305): a, c, t, g, unknown or other
  misc_feature (305)..(305): n is a, c, g, or t
  modified_base (438)..(438): a, c, t, g, unknown or other
  misc_feature (438)..(438): n is a, c, g, or t
  modified_base (440)..(442): a, c, t, g, unknown or other
  misc_feature (440)..(442): n is a, c, g, or t
  modified_base (444)..(476): a, c, t, g, unknown or other
  misc_feature (444)..(476): n is a, c, g, or t
tcagagtatacatacacgaccggtgctcgatttagatcgtctgtgttgggtttgggatctacgttgcaggtgtaggtctgggtgccgattcgccttctccagagacaattccaagagcacggttcatctgcaaatgagcgccctgagacctgacganacggctgtctattactgtgcgagagggcgtcgagttaacacgccgtgggaggattattattgacaagtcggggaccaggggaccctggtcaccgtctcctcgacgcctaccaccgaaggccctaagtccggtcccttccccgggaccncccctggcctccgaaggcgaccaccgtcggaagacaccacgtagccggccccgtggggctcgccgtggacaaacggacttacttctagtcgtaactcgtactgcgcgggctggaacgagggccactagtacgnannnannnnnnnnnnnnnnnnnnnnnnnnnnnnnnnnn

SEQ ID NO: 274136 - DNA, 870 bp, Homo sapiens
  misc_feature: GYAE6OF02G38N2.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaagggctggagtgggtggctgttgtgtcaaatgatggacatgctgaatatgcagacctccgtggagggccattccgccttctccgagacgactaattccaagacgcgtacggttcactctagacaaagtcgacgccgccgtagacgaccgtagaccgacgaccgtctgttacttaagttacctggtcggcggaagggtacgggtccggttaccgtaacggttttaaccgaccggtcccgggtaggggaacggtaatttacgttttaacgtttgaaaccgtacggtacggggacccgtaaacggggtaacccgttacggtaccgtacccgttcccgttacccgtacccgtaccggtacccccgttaacccggaaaccccggtaacccgggtcccccttaacgggttttcccccgggtttacccccccgttttacccccccggggtacccggggtccccccgtttaccccccggttacggcccccgtttaccccgggaaccggggtaccccgttaccccccgtaaaccccggtttacccgggaccggaacccggttaacccccgtaacccgggtacccggggtacccccgggtccccccggggttagggggttaccccgttccccggggttacccggtttaacccgggtaaccgggtaaaacccgggttttacccctttaaaccccgtttttaccccggg

SEQ ID NO: 274137 - DNA, 738 bp, Homo sapiens
  misc_feature: GYAE6OF02HF9DK.48.34.D01.1.454.CMB.1.raw
tcagagtatacatacacgaccggtgctcgatttagatcgtctgtgttgggtgcagttggtggagtcgggggaggtgtggtccagcctgggaagtccctgacactgtcctgcgcagcctcgtggattccacccttcacctacctttcgtaatgctacttttcgtccgccaggcctccgaggccaaggggtctggaggtgggtgcttggttcgtgtacaaatgagtggacagtgctagaatatcgacacgtacctccggtaggacggggcctattccgcctttctccgaagacgaaccttaatcccgaaagtcgcgtacggtcatccgtagactaaagtcgaacggccgtcccgtagacgaccgtaggaccgaactcggtctaggttaccttagtacgtgtaggcggaaggcgggtacgtaccgtaagtttaccgcggtccgtacggggtacgtaagttatttacgtacgaacgtacggtacgggaccgaacgggtacctcggtacctacggttcctaccgtccgtaccgtcccgtacccaaccggtaaccgccctacggttccgttccccgttacccggttccggtcccgtaccctcgcccgtaccggacgtacccgtacccgacccggttaccgaccgaccgtacccgtaccggcccggtacccgggtccccggttagggtacccgtcgggtacccggttacggtaacccggtaacggttacccgttacccttaaccg

SEQ ID NO: 274138 - DNA, 778 bp, Homo sapiens
  misc_feature: GYAE6OF02FT984.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtggacgggccgattcgccttctccagacgactaattccaaagtcgctacggttcaattctgacaaagtcgacgccgccctaggacgtacgtgacgacgtacggctagtactaattaccgtggtgacgtaagggcggtaccgtacgtacgtttaacgacggtccgggtagggaacgggtattacgtttaacgtttcggaacctaacggtcggggaacctacggggaaacccgttcggttaccgtaaacccggttcgtacccgtaccggtaaccgtcccctaccggaaacccggtaaccgggtaccccgtacggttaccccgggtttaccccgttaacccccggtcgggacccccggttcccgttacccggacccgtttaacccgaacgggtacccgaaccccgttacccgtaaccggaccgtaaccggtacccggaacccggtaaccggggaccccgggttcccggtaccggggttccgttacccgggtacccgggttaacgggttaccccggttaacgggtacccgtttaccctttaaccccggg

SEQ ID NO: 274139 - DNA, 965 bp, Homo sapiens
  misc_feature: GYAE6OF02I1IB0.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcacctacctttcgtatgcacttttgtcccgccaggcctccgaggaccgaaggggtctagggaggtgggtcggtctgttgtgtacaaagtgagttacggactagttcgacgttagtaaacttagtacggtacgtaacggtaccgttccgggttacgggaccggggtaccgttacgtttacccgtacccgtttaccgttacccgaaagtacggtaacctaaaccgtttaaccgaaaggtaccgtaccggttaacgtttaccgtaacgttccgtaacggtaaccgtaaaacgttcggaaccggtacccggtacccggttaacggaacccgggtaacccggtttaacggaaacccggtacccgggtaaccgggttacccgtttacggttaaccgtttaaccgtttaccggtacgttaaccggggaacggtaacggggtaacgggtcccggtttaacccgggttaaaggttttaacccgacgggtacccggggtagggtaacgggttaactttacgtttaaccgttaaggaacccgtaaccgggtcggggtaacccgtaaccgggtaaccctcgggtaacccgtcccgttacctacccggtacgtaaccgttaccccgtaaccgtaacccggaccggttacccgtaccggttacccgttcccccggtttacccggtaccggaccccgttcccttacgggtacccgaacccgtacgggtaccctaaccgtacccgggtaaccgaccgtaacgtcccggtaaacggccgggtaccgtcccggttaacggtccgacggttccggaacggttacgtaaaccgttacccgttacgtttaccgg

SEQ ID NO: 274140 - DNA, 728 bp, Homo sapiens
  misc_feature: GYAE6OF02HXO18.48.34.D01.1.454.CMB.1.raw
  modified_base (137)..(137): a, c, t, g, unknown or other
  misc_feature (137)..(137): n is a, c, g, or t
  modified_base (418)..(418): a, c, t, g, unknown or other
  misc_feature (418)..(418): n is a, c, g, or t
tcagagtatacatacacgaccggtgctcgatttagatcgtctgtgttggggttgggggctgtgggctcaggaggcagagctctgggaatctcaccatggcctcggacccctctcctgcctccccctcctcacctttntcgcacagttctcgtgacggtcctcctctgacgtctcgacaccgacgccctaccccgtcggtgtcacggtcgtaccccaaggaaccaaaccggtccgaaggactcccgtacctagtccttacggtaggagagttcgactacgttacgaacctaaaggtttaaaatttttgtagttacggtaaccaacgtgaacggtcgacggcctaccggtcccctgttccgtagtactattttaggcggaacggaccgacgacgtaccaccctacggacgacttcccggngtaccgtaggttctacggacggtactaccggaactggacgggtactacgtccggtccctaagttcacttacgcgaacgggtccgggacctgggtacgggtaacggtgtaacggtaggtacgtacgtttacgttcgttacgttacgacgtaaaccgcgtaccgtaaccgtgtaaccgaattaacgactacgtcggtacgttaccggttcgggaacggtacgaccgacgtacgtccggacgttccgggagtcccgaggtaacccaggtccctacccggtccgtccggtaactccgttaccgccgttaccccg

SEQ ID NO: 274141 - DNA, 709 bp, Homo sapiens
  misc_feature: GYAE6OF02G77IC.48.34.D01.1.454.CMB.1.raw
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (532)..(532): a, c, t, g, unknown or other
  misc_feature (532)..(532): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggttggggctgtgggctcgaggaggcagagctcgtgggaactctcaccatcggcctcggaccctctccgtgcctcccctctcactttcngcacntctcgtgacgcctctcgngacnctacgacacgaccgccctccgtcgtcgtacacgtccgacccgaacgaacgaaccggcgaacgcttaccgacgtcggtaccttcggaaggacgcggtcgtacgttcgtttaaccgaaaccgttaaaagttttaaagttttcggttaaacgttccggtaaacctaacggttaaggtaaccgtacggaccggaccgtacccggtacccttcgttcctaggttacttagtttacgacgggtacggacccgtaaccacgtcccgtaccgtacgacggtacctcgtacgngttaccgtcgtacgacgtactacgacgttacgacgtacgttgtccgacctttagtacgtactaacgtccggttacgccgggaaccaaggggtcgacgtaaagggttaccgagggttactactttacggtttaccgttaacgttccaaccggaaagtcccgaacgtaccgtagtaacc

SEQ ID NO: 274142 - DNA, 700 bp, Homo sapiens
  misc_feature: GYAE6OF02GCNN0.48.34.D01.1.454.CMB.1.raw
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactcgngagggccgatcgccttcnccagagacaattccaagtacgcacggttcatctgactaaaatgaacgccgccctaggaacgacctgaccgacaccggctagtctattactgtgcgagacgggcgtccgtaagtttaacgcgtccgtcgggagggtattacgtttacgttgacgtaacgtcggggaccgacgggtaacccgtggtaccgtaccgttacctcccgtccgaccgtccctacccgaacccggaaccgggacccctaacgttcccgggttacccgtttacccccccggtacgggccccggtaccccgttcgtaccccgttacccgaacgggaccgacccgtaccccgttacccggacggtacgaccggtaaccggaccggtacccggggtccccgtcggggttaccctcgggtcccccggtttagggtacccggtaaacgggtacccgttaccggttttaaccc

SEQ ID NO: 274143 - DNA, 983 bp, Homo sapiens
  misc_feature: GYAE6OF02F89E5.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtcccgccaggctccaggcaaggggctggagtgggtgctgttgtgtcaaatgatggacatgcttagaatagtcgacaacgtacctccggtggacggggtcccgtaagtttccggacccctttccgtacccaaggaacgtaacctaaactttacccgaaacgacggtacccgtaaccggggtttccaacgttaccgttaggaccctaaaaggttacggaccggtacccggtcccccttaagggtaaccgtacccgttacggaacccgaaacccggacgggtccctttacggttacctttaaacggtttacgtggtcgggaccggtaacggggtacggggtaccgtttaccccggtaacggtttttaaaccgacccggggttacccggggtacgggggttaacgggtaactttaacggtttttaacggttttaacggaaaccggttaccgggtacgggggtaaacccgaaccggggtaacccggtttaccgggtacccgtaacccggtttccgttaccccgtaccgtacccgtaccccgtacccgtaaccccggtaaacccgggtccctaaccggtttccccgggttaccccgttttcccccccggtacgggtacccccggttacccccgggtccgtaccccgggtttccgggaaacgggtaccccgtacccggttaaccccgttaccggaacggtacccgggaaccgtaacccggtaacccgggtcccccgggtaacccgggttcccgggtacccggtacccgggttacccgggttaacggggttaaccccgaaacccggggttaacctttaccccccgtttaaccccgg

SEQ ID NO: 274144 - DNA, 595 bp, Homo sapiens
  misc_feature: GYAE6OF02GGVJ9.48.34.D01.1.454.CMB.1.raw
  modified_base (342)..(342): a, c, t, g, unknown or other
  misc_feature (342)..(342): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagggccattcgccttctccagagacaattccaagacgcacggttcactctagaccaaatgagcgccctgacgacctcgacgacacggctgtctattactgtgcgagnggacgtcgagtttaacgcgccggtgggaggtatattacgttgactacgtgggacacgggacctggcaccgtctccncncgcctaccaccgaacggcccacgttccgtaccgttccccgacgggccctcccgtcgtccctaccgacggacctccgacccgtcgacgtcacccggtaacgaccggcccggtacccggtcggtaccgttaccggtcccgttaggtacccgaaccggttacccttaccgttaacccg

SEQ ID NO: 274145 - DNA, 805 bp, Homo sapiens
  misc_feature: GYAE6OF02G9FR1.48.34.D01.1.454.CMB.1.raw
  modified_base (470)..(470): a, c, t, g, unknown or other
  misc_feature (470)..(470): n is a, c, g, or t
tcagagtatacatacacgaccggtgctcgatttagatcgtctgtgttggggttgggggctgtgggctcaggaggcagagctctgggaatctcaccatggcctcggacccctctcctgcctccccctcctcactttctgcacagtctctgacggcctcctctgacgctagacaccacgccctacccgtcggtagtctacgttccgtcccgaaggaaccgtaaaccggccgaacggtactcctaccgtcgtccgtaccgtagggacgtagttcgactacgttacgaaccgttaaaagtttaaacgtttttcgttaagttaccggttaaaccacgtttagaacggtaccgaacggccctacggtccccctggttcccgtgttacttagttcgacggtacgacccaccgttcgaccgaccccgttagacgtacctcccgtagaccggtacgttctacgtgaaccgtacgtaacncgtaagggtctagtaccggtcctaagttacaccttaacgccgttacggtacccgggaccgtaggggtcggtaaggtacgtaaggtaacgtacggttacccgtttacgtttccgtttaacgtttcttaaccgtaaaccgtaacgtacctaaccaacgttaccgtaacgttaacgtacgtaggttacgtaccggttaacgttttaccggggaacggtacggtaccggtaaccgtcggtaaccgtccggttccgggtacggtaccgacggttaacccggaccgttacgttaccccgtcccggttccgtaacgtttcccgttagttaccccgttccccg

SEQ ID NO: 274146 - DNA, 809 bp, Homo sapiens
  misc_feature: GYAE6OF02IN898.48.34.D01.1.454.CMB.1.raw
  modified_base (703)..(703): a, c, t, g, unknown or other
  misc_feature (703)..(703): n is a, c, g, or t
tcagagtatacatacacgaccggtgctcgatttagatcgtctgtgttgggtgcagttggtggagtcggggggagtgtggtccagcctgggaagtccctgacactgtcctgcgcagcctctggattcaccttcaccctaccttttcgtatgctacttttgtccgccaggctccgaggcaaggggctggagtgggtgcttgttgtgtacaaattgatggacatgctagaatatgacaagtacctcggtggacgggccattccgtccttcaccaggatactaattacccgaagacgcgtacggttcattacctgaacgaaagttcggacgtacccggtacctagaaccggtaccgtacgaaccgaccgtacgggtcttacggttaccttaacgttaccgtggtacgacggtaagggtaccgggtaccggttaacccgttaacggtttaaaccgacggggttaccccgggtaggggtaacgggtactttaacgtttaacgtttagaaccggtacggtacggggtacccgaaacgggtaacccgttcggtaacctaaccgtcgttaccccgaacgacccgttacccgtaacccgaaaccggtacccggtacccgtacgttccccgggtttacccttccccgtaccgggtcccctcccgggttcgacccttaccggaacggtcccgacccctaacccgtaccgggacgnggaacccgaccgggtaacccggcccggttcccgggtacgggttcccgttccggtaaccccggtttggtaacccggtaacgggtttacccctttacgtttaacccgg

SEQ ID NO: 274147 - DNA, 795 bp, Homo sapiens
  misc_feature: GYAE6OF02HAEMS.48.34.D01.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (374)..(374): a, c, t, g, unknown or other
  misc_feature (374)..(374): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccctacctttcgtatgctacttttcgtcccgccaggcctccgaggcgaaggggctggagtgggtgctgttntgtanaatgagtggacntgctgaatntgngagaccgtcggtgggacgggcctattccgtccttctccagagactaacgttccaagacgcgtacggttcatctagactaagtcgacgccgcctaggacgaccgtcgaccgacgaacgtccgttagtaccgttagtttacncggtaggaccggaagggaccggggtaccgtttacggttaacggttttaaacccggaccgggtcccggggtacgggggaacgggtactttacggttttaaccgtttacgggaaccggttaaccgggtccgggggtaacccgggtaaacccgggttaccccgggttacggtaccccgtacccggttccctacccgtacgacccgtccctaaccccggaacccgtaccgggtacccgtacggtccccgggtttaccccttccccgggtaccggtccccgtacccgtccgccggtaccgaccggtacccgacccgtccgtacccggacgtaccgaccgtaccggacccggtcccggcccgggttacgggtcccgtcggtcccgggtaccggtaaccggtaccgtttaccggtaccgtttaaccgg

SEQ ID NO: 274148 - DNA, 947 bp, Homo sapiens
  misc_feature: GYAE6OF02IMLK7.48.34.D01.1.454.CMB.1.raw
tcagagtatacatacacgaccggtgctcgatttagatcgtctgtgttggggttgggggctgtgggctcaggaggcagagctctgggaatctcaccatggcctggacccctctcctgcctccccctctcactttctgcacagtctctggaggtcctcctctgagtctgaaccacgacgccctacccgtggtcgtcaggttccgtaccccgaagggaaccaaaccgggccaagggtactaccgtaccgtcggtacttcgtggaacgtatcggacttacgttacggaaaccttaaaaaggtttaaaacttttttggtttaacgtttaccggggtaaaaccctaaacgttaggtaaacggttaccgaaccgggtacccgaaccggggttaccccccttgggttaccgttcgggttaacttaagttttacgaggggaaccggaaccgtaacgccggtaacccgtacccctacggaaccggtacctcccggtaggtacggtaccgtttcgtacgtggaaccttaacgtaccgtcggtaagggtacttacggttccggtaacccttaaccgtttgtaaaccgttacgttcccgggacccgggttaccggggtacccggtaaggggtaacggtaagggttaacgtaaacgggtacggttacgtttaacccgttacgttttaccgtttccgtttaaaccaccggtaaaaaccgaccgtaaacctaaccgggtaacgtaaccgtaacctaacgttacctagggttaccgttacggttttaaccggggtttaccggaacgggggtaaaccgtaaccgtaccgcggttaccccggaaccgggttccggttaaccgggaacccgaccgggttaacccggtacgggttccccgtttacccccgggtacccgtttacccgggaccttttaccccggtacccgtttacccccgttaacccccg

SEQ ID NO: 274149 - DNA, 783 bp, Homo sapiens
  misc_feature: GYAE6OF02JIIW2.48.34.D01.1.454.CMB.1.raw
tcagagtatacatacacgaccggtgctcgatttagatcgtctgtgttgggttggggctgtggggctcaggaggcagagctctgggaatctcaccatggcctggaccctctctgctcccctcctcactttctcgcacacgtctctgacggtcctcgtctagacgctacgacacgcaccacccgttcggtcgttcgtacgttcgtacccgtaggaaccgaaacggccacgggtactcctacctacgtcttcgtcggaacgtacgtcgacctacttcgaaccgtaaagtttaaaacgtttgtttaacgttacgtaacctacgttagtaacgttcaacggcctaccggtaccctgttacccgtacggttaccgtaactttaacgtaccggaacggtaccgtaacgtacggtaccgtacccgttacggaacggttacctcccggtaggtaccggttaccgttacgtacgtaaggtaccttaccggtactcggaacggtcttacgttaccgaccgttaccgtacgtaacgttaccgccgtaccggtaccgggaccagggttacggagtacgtaggtacgtcgtacgttcgtacgttcgttaccgacgtaacgacgttaaccgtacgtaggtactaactaacgtctaaggtacgttccgttacggttaacgggaccggtacgaaccgttacgttacggtacgtaccggtaccggtagggtaccgtaaccgaccggtaactcccggttacccgtccgttaaccgtacgtccgttacccacccggttacccc

SEQ ID NO: 274150 - DNA, 824 bp, Homo sapiens
  misc_feature: GYAE6OF02H9KXW.48.34.D01.1.454.CMB.1.raw
tcagagtatacatacacgaccggtgctcgatttagatcgtctgtgttgggtgcagttggtggagtcggggggaggtgtggtccagcctgggaagtcccctgacactgtcctgcgcagcctctggattcaccttcacctacctttcgtatgctactttcgtcccgaccaggctccgaggacgaaggggctgggaggtggggtgcgtgttgtgtacaaagtgatcggacatcgctagtaatagtgacagtaccgtccggtagggacggggaccgttacgttccggtccctttccgtacccgaaggacgtaactaaccttaccgaaaggacgtacgtaccggttactacgtccgtagacgtaaaagtcggacgcccgacccgttaggacgtaacccgtggaaccgaccgtaccgtcgttacgtacgttaacttaccgtaggcggtacggtagggccggtaccggtttacccggtaacgtttaaccggcccggtcgggtaggggtacggttacttagttttaaccgttcgaaccggtaacggtccggggtacccgtacgggtaacccggttggtacccgtaccgttccctacccgtgtacccgtacccgtaccccgaacccggtaccggaccccttcggttcccgttccccgttcccggtaccgcccgtacccggtccgtcccgtaccggaccggtcgtacccctacccgttaccgggaacgaccccgggtaccaaccgggtaccccgggtcccggtacccggtccgggtacgtcccggtaccggttaccggttaacccggtacggttacccgtttaccgttacccgg

SEQ ID NO: 274151 - DNA, 820 bp, Homo sapiens
  misc_feature: GYAE6OF02IVQME.48.34.D01.1.454.CMB.1.raw
  modified_base (228)..(228): a, c, t, g, unknown or other
  misc_feature (228)..(228): n is a, c, g, or t
tcagagtatacatacacgaccggtgctcgatttagatcgtctgtgttgggtttgggcacgaccggtactcgatttagatcgtctgtgttgggtttgggcacgaccggtgctcgatttagatcgtctgtgttgggttggggctgtgggctcgaggaggcagagctcgtgggaatctcaccatcggcctcggaccccctcgtcctgccctccccctcctacgtactttcncgccacgtagtcctcgtaggacggtccccttcctctggacgcctacgaccaccgaccgccccgtacccgttggtacgtcgacggttcccgtacccccgaaggtaaaccccgaaaccgggccgtaacggtactacccgtaacccgttcggacccgttaccggtaggaacgtaacgttcggtaccgttaacgttaccggaaaccgttaaaaaggttttaaaacgtttttggttaaacggtttaacccggtaacccgtaaagttaacggtaaaccgtaccgtaacgggaccccgtacccgggtacccctttggttaaccctcgggttattaacgtttacggacggaaccggtaaccgaccgtaacgaccccgtaacccgtaccgtacgtaccgttcccgtagggaccgttcggttcctacgtaggtacgtaccgacgtaacggaacgtccttaggtcccgaccgttaccgtagtactcggtaccgtacgggtaccggtccgaaggggttcgaacggtgtaaccggacggttacggtacctttaacttccggttacttaccgaacgaacgttccgaacctacggtacgtacgtaac

SEQ ID NO: 274152 - DNA, 674 bp, Homo sapiens
  misc_feature: GYAE6OF02FVMZC.48.34.D01.1.454.CMB.1.raw
  modified_base (263)..(263): a, c, t, g, unknown or other
  misc_feature (263)..(263): n is a, c, g, or t
tcagagtatacatacacgaccggtgctcgatttagatcgtctgtgttgggtgcagttggtggagtcgggggaggtgtggtccagcctgggaagtccctgacactgtcctgcgcagcctctggattcaccttcaccacctttcgtatgcactttgtccgccaggctccaggcaaggggctggagtgggtgctgttgtgtcaaatgatggacatgctagaatatgacagacctccggtaggacggggtcctatttccgcctttcnccagagactaacttaccaaagacgcgtacggttcatcctagacaaagtgacgtccgacccctgacgtacctcgaaccgtacgacggtctgtacttattacgtgtacgcgaggacgggtccgtacgtacgtttacgaccggtccggtacggggacggtattacgtttacgttagacgtaacggtagggggacccaacgggtaacccgttggtaccgtacccgttcctacccgtactcggtaccccttaccgaaccggaaccggtcccgtaaccgttccgggtccctttcccccgcggtaccccgtccgtcgtccctacgcggtaccgtccgtaaccgccgtagcctaccgcgaccggtcccggtaccgtcggccgtcgtcccgtaggtacgaaccggttcctaccgttaccg

SEQ ID NO: 274153 - DNA, 968 bp, Homo sapiens
  misc_feature: GYAE6OF02JLPTP.48.34.D01.1.454.CMB.1.raw
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
tcagagtatacatacacgaccggtgctcgatttagatcgtctgtgttgggtttgggcacgaccggtgctcgatttagatcgtctgtgttgggtttgggcacgaccggtgctcgatttagatcgtctgtgttgggtttggggctggtgggctcaggaggcagagctctgggaatctcaccntggcctggacccctntcctgcccttccccctactctactttcgccacngtcctcgtacggacggtccctccgtcgtagacgtctacgaacacaccggacccctaccccggttggtaccgtccaacggttccgtccccccggaaaggaaccccgaaaccgggcccgaaacggtacgttacccaaccgttggacccttacggtacggggaagtacttacggtaccttaacgtttaccggaaacccggttaaaaaagtttttaaaccgtttttttcgggttaaaccggttttaacccgggtaaaccccttaaacggttaaggggtaaacccggggtttaaccgacccggggggtaccccgtaaacccggggttcccccctttagggttttccccgttaaggtttaacccgttttaaacgtttttaacggccgggtaaaccgggaaccggttaaccccggtaaccggtacccccggtaaccccgttacccggtaaacgggttacccttacccggttgggaacccgtttacggttacccggttacggtaacgggtaaccttaaccgtaaccggtaccggtaacgggtaccgttacggttaccccggtaccttaaccggtttagtaaccgtttaccgtaccggtaaccgggttaccgggaccgggttacggtagggacgggtttaaggcggggtttaaaacggttccgttaaaccggtttcgttttcccggtttaacggttttaaccctaaccggtaaaccggtactaacccggttacggttaacccggtaacg

SEQ ID NO: 274154 - DNA, 820 bp, Homo sapiens
  misc_feature: GYAE6OF02HCK4D.48.34.D01.1.454.CMB.1.raw
tcagagtatacatacacgaccggtgctcgatttagatcgtctgtgttggggtgcagttggtggagtcggggggaggtgtggtccagcctgggaagtccctgacactgtacctgcgcagcctctggattcacccttcaccacctttcgtatcgctacttttgtccgccaggctccaggcaaggggctggagtgggtcgctgttgtgtcaaatggatcggacagtggctgtaatatgacagacctccgtgacggggccagttccgcgttcctcgagagacaacttccgaacgacgcgtacggttcactctacgactaatggacgtccgcccgtacggacgtaccgtacgaccgacgaacggtccgttcgtaccgttacgttaccgtggtacgaccggagggtaccggggtaccggtttacccggtaaaggttttaaccgaaccgggtccgggtacgggtaacggggtaactttaaccgtttaacgtttacggaaccgttaacggtacgggggtaaccgtaaccgggggtaacccgttacgggtacccgtaacccggttcccgttacccggtacccgtacggaccccttacccgaaacccgggtacccgggacccgtaccgtttacccggttcccttacccccgggtccggtaccccgtcccgttacccgccgttaacccggacgggtaccgtacccgtaccccgggtaaccggtaccggacccggtaccgtacccggtaaccggtcccgggtaccccggttcggacccggtttaccgccggttacgggtaaccgtaaccggttacccgttacccgttccccg

SEQ ID NO: 274155 - DNA, 285 bp, Homo sapiens
  misc_feature: GYAE6OF02FTISX.48.34.D01.1.454.CMB.1.raw
  modified_base (243)..(243): a, c, t, g, unknown or other
  misc_feature (243)..(243): n is a, c, g, or t
  modified_base (248)..(285): a, c, t, g, unknown or other
  misc_feature (248)..(285): n is a, c, g, or t
tcagagtatacatacacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctcgccccctggtcactctgttccccgccctcctctatgtatactctgagcgggctgggacaggcncatgnnnnnnnnnnnnnnnnnnnnnnnnnnnnnnnnnnnnnn

SEQ ID NO: 274156 - DNA, 903 bp, Homo sapiens
  misc_feature: GYAE6OF02F1A6X.48.34.D01.1.454.CMB.1.raw
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggcctccgaggcaaggggctggagtgggtggctgttgtgtacaaagtgatggacagtgctagaatatgacacgactcggtggacggggcctagttccgtccttcgaccgaagacgaactaacgttacccaaaggcgacgtaccggttacacgttcgtacgaactaaacgtcggacgtcccgccccgttaggaaccgtaccgtcggaaaccgaccaccgggtcttacgttacttaacgtttacggtggttacgacggggaacgggtacggggtaccgtaccggtttaaacggttaaaccggtaccggggttacccggggttaacggggaacgggttaacttttaaccggttttaacgtttaaccggtaaccgttaaaccggggttaccgggggaacccggtaaccggggtacccgttcgggtacctaaccccgggttcccttacccggccgtaaccgtaccccgtacccgaaacccggtaacccgggtacccgttaccggtttaccccgggttcccccgtttaccccccggccgggtcccccgttaccccgttcccggttacccggtaacggaacccggtaccggtaccccgtacccggtacccggaacgtaacccggaccggaacccgggtacccgggtacccccgggtaccccggggttcggtaccccgttcgggttaccccgggttaccgggttaaccccgggttaaacccgtttacccgttacccccgtttttaagg

SEQ ID NO: 274157 - DNA, 859 bp, Homo sapiens
  misc_feature: GYAE6OF02JTYUF.48.34.D01.1.454.CMB.1.raw
  modified_base (126)..(126): a, c, t, g, unknown or other
  misc_feature (126)..(126): n is a, c, g, or t
  modified_base (167)..(167): a, c, t, g, unknown or other
  misc_feature (167)..(167): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
tcagagtatacatacacgaccggtgctcgatttagatcgtctgtgttgggtgcagttggtggaggtcggggggagggtgtggtccagcctgggaagtccctgacactgtcctgcgcagcctctggnttcaccttcacctacctttcgtatgctactttgtcccgccnggcctccacggcgaaacgggggtccgtagggtaggttggggtggacgttggttgttcgtacgtaaacgtggatcgggaactagttgccgtagtaaagttaaccgtgtaccgaacggtaaccgttcccgggttagggccgggggtacccgggttaaacttcccggttaccccgttttacctccgaacgtaaccggaaccttaagtttaccccgaaaggcgtaccgtaaccgggtttnaactcgttcggaanaaccgtggtaaccgtccgaccccgttacggcggtaccccgtagggtacccaacggtcggtccttcgggtactttacggtaaccggtttccggtaggtacgggtacggaccggggttccgtaaccggttaccggttaaacgcccgggttacggtaccggggtagggaccgtttaaagtttacccgttgaccgttaacggacccgggtaaccggtacggtacccgttagtcccgtaacccgtcgtcccgtaacgccgccctacccgacgtaccggtacccgtaaccgttccggttacccgtcccgtccggtcccgtccgtccgccgttacccggcggtacgttaaccgcccgagtaccgcgggtaacccacggtcccgggccgttccggtaccggtccgttaacccgtcggtacggtacccgtaaggtaccctaccgttttccg

SEQ ID NO: 274158 - DNA, 857 bp, Homo sapiens
  misc_feature: GYAE6OF02GBURP.48.34.D01.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagagtatacatacacgaccggtgctcgatttagatcgtctgtgttgggtttgggggtgggctcaggaggcagagctctgggaatctcaccatggcctggacccctctcctgcctcccctcctcactttctgcacagtctctgacggcctcctctgagctgacacacgccacccgtcggtgtcagtcgtcccaggacaacggcaggancactgactgngganatgctagttcgacctaaaagttaaaactttttgttacgtttacggtaacctaactaggtaaacgtcgaacggccgaaccggtccccctggttaccccgtggttactaagtttttagacgggacggtaaccgaaccgtaggacccggtaccctccgaacggtacctcccgttgacggtcggttcttaccgagtactaccgtaaccgtgaacgggacttagttacggaccctacctttaggaacttactaccgaaccggggtttcccggggcccggtaaggggtacggggtaacggtaacgggttaacggggttaaacggtaccgggtttaacctttaccggtttttacggttttaccggtttaaccttaacccggtaaaccgtaccggtaaaccaacccggttaacggtaactaaccgtaaacgttaccgtaagttaaccggttcggtttaaccgggttttaccggggaaccggggttaacgggaaaccgtaaacggtccgttaaccggacccggtttcggtacccgggtacggtacccggtaacccgacgggttacccccgcccggttacccccggtaccggtcccgttaacccgtttcccgttaccccggttaccccctacccgtttaacccc

SEQ ID NO: 274159 - DNA, 706 bp, Homo sapiens
  misc_feature: GYAE6OF02F2Q8M.48.34.D01.1.454.CMB.1.raw
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
tcagagtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgcttgaatatgcagactccgtggacggggcctagttccgccttcctccagagaactaattaccaaggagctacggttcnctctagacaatgacgccgccctgacgtaccngaccgacgacggctgtcttatacgtgcgtacggaggacggcgtaccgtacgtttaacgaccggtccgggtacgggaacgggtacttacgtttaacgttcgaaccgtaacggtcggggaaccgtaacggggtaacccgtcgggtaccctaacccgttcctaccctaccgacggttacccctacccgaacccgaccgggtaccccgtacggtttccccggttccccgttcccccgacgggtcccgtcccgtcggtacccttaccggaccggaccgtaccgaacccgtacccgtagaccgtaccggtaaccgccgggtcccggacccggttcggaccgttccggtccggtacggtaccggtaacggtacccgttaccgttaccgg

SEQ ID NO: 274160 - DNA, 887 bp, Homo sapiens
  misc_feature: GYAE6OF02GMZPE.48.34.D01.1.454.CMB.1.raw
  modified_base (133)..(133): a, c, t, g, unknown or other
  misc_feature (133)..(133): n is a, c, g, or t
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
tcagagtatacatacacgaccggtgctcgatttagatcgtctgtgttgggtgcagttggtggagtcgggggaggtgtggtccagcctgggaagtccctgacactgtcctgcgcagcctcgtggattcaccttnaccctacctttcgtatgctacttttcgcccgaccgacggtctccgaaggcgtaaggggctgggagttgggngtcctgttgtcgtactaaatcgatcggaacngtgacgtanaatagtcgacgacgtactcggtaggacggggtctacgttccgtaccgttccgtaccgagaacgtaacttaaccgttaccgaaaggtacgacgtaccggttacacgttactacgtaactaaacgttcgaggtaccttccccgtaagtaaccgtaccgttcgaccgtaacgtaccgggtacttcggttaaccgttacttaccggttcgtaccggtacggggtaacgtacgggtaccggtttaacgttaaccgggtttaaaccgaccggggtacccggtttaacgggggaacggttaacctttaacggtttaccgttacggtaacccgttaacgggttaaccggggaccgttaaaccgggacccgttacgggtcctaaaccccggttccgtacccgacccgttaccggttcccgtaaaccgtaccccggttaccggaaacccttcgggtttaaccccgttcccggttacccccggttcggtaaccccgtcccgttacggtccctacccgggaacgtacccggtacccgtttaaccgggacccggtacgtaccgtcccggtaaacgtccgggtcccgtacccggtaccgggttcttaccggtccggttaccggttacgaaccggtttacccgttcgtttaaccccgg

SEQ ID NO: 274161 - DNA, 1002 bp, Homo sapiens
  misc_feature: GYAE6OF02F0NU6.48.34.D01.1.454.CMB.1.raw
tcagagtatacatacacgaccggtgctcgatttagatcgtctgtgttgggtgcgagttggtggagtcggggggaggtgtggtccagcctgggaagtccctgacactgtcctgcgcagcctctggattcaccttcaccctaccttttcgtatgctacttttgtcccgccaggctccgaggcgaagggggtctaggacggttggggtggtacgttggtttggttagtaccaaaattcggagttacgggactaacgttcgccgttaaggaaagtcgttacggactaaccggtaaccgtttccgggtagggaccggggggtccctaatttccccggtcctttccgtaaccgagaacgtacctaaacgtttaccccgaaaggtacgtaccggttaccggtttactacgttaccgtacggtaacgttaaaagcggtaaccgcccggttccccgtaagggtaacccgttaccgacggaaccggaaccgtccgggtcttttaccggttacctttaacggtttaccgtttacgggacggtacggggtaacgggggaccgggtttaccggtaaccggtttaaacggttttaaacccgggaccggggttaacccggggacgggggttaacggttaacgtttttaacgtttaacccgtttagggaacccgttaaacggggtccggggtaaccgggtaacccgggttaacccgtacggttcccgttacccggtccctcccgttacccgtaaccggttccccgtaacccgtaaccggggtaacccgtaccccggttacgttacccccgggtttccccctttcccccgggtaccggttccccggtaaccccgttccggtaccccggtacggtaacccgggacccgttaacccggaccgtaacccgggtaccgaccgaccggtaacccgggacccggtcccgggttccccgggttagggtccgttaccgtcggttaaaccggttaccggtaaccgttaccgttacccggtttaaccgg

SEQ ID NO: 274162 - DNA, 742 bp, Homo sapiens
  misc_feature: GYAE6OF02G2VR1.48.34.D01.1.454.CMB.1.raw
  modified_base (113)..(113): a, c, t, g, unknown or other
  misc_feature (113)..(113): n is a, c, g, or t
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
tcagagtatacatacacgaccggtgctcgatttagatcgtctgtgttggggttgggggctgtgggctcaggaggcagagctctagggaatctcaccatggcctggaccccctntcctgcctccccctctctactttcacgcacagtcctcgtaggaccggtccctcctctagacgtcctagaaccacaccgtacccctacccggttggtcgtacctaggtccgaccccgaaggaacgaaaccggccgaaggtactccgtaccgtgtaccgttcggaggagtacgttcgacttaagttcgaaaccgttaaaatttaacgtttttcgtaagttaccgtaccaaagttacgaagtcgaacgccgtacgacccgttgtctacggtactagttaggacgtaacgccgtaaccgcggcctaaccgcgtagacctccgtagtaacgtctgtacagtaccgacgcgtacgaggttcacggtacgtacccttaagnaaccgtacnccgtaacgggccggtacgagggtacggagacggtaacgtacggtaacttctacgtttcgttacgtacgtaacgtacgaactacctaaccggtataacgaacctacgtagtagtaaccgttcggttaaacgttccggaaggaccgtaagaccgttacctccggacggttaccgaacggtaccgaaccggtccgaccgttaccgtcccggtcccgtacgtaccgtacccttcgttaccccggtacccc

SEQ ID NO: 274163 - DNA, 906 bp, Homo sapiens
  misc_feature: GYAE6OF02H3DZA.48.34.D01.1.454.CMB.1.raw
  modified_base (246)..(246): a, c, t, g, unknown or other
  misc_feature (246)..(246): n is a, c, g, or t
tcagagtatacatacacgaccggtgctcgatttagatcgtctgtgttgggtttgggcacgaccggtgctcgatttagatcgtctgtgttgggttgggcacgaccggtgctcgatttagatcgtctgtgttgggttgggctggtgggctcgaggacggcagagctccgtgggaatctcgaccagtcggccttcggaccccctcgtaccgtcgcccttcccccctcctcgtacctttcgtacgcaacncgttctcgtaggacggtcctccgtacgtgactcctacggacacgaccgcctaccccgtggtactccgtcgttccgacccgtaaggacgtaaaccggccaggtacctacccgtacgttcgtccttacggtagaagttccgtacgtacttacggttaccgtaaacccgttaaaaagggtttttaaacctttttcggggttaacgtttaacccggaaacccttaacggtaaccggtaacggttacccggaaccggacccgggttaaacccggtcccccggtaacggtttcccgggttaaccgttaacgtttaacggtttcggttaacgggaccgggtaacccggtaaccacccgggtttaccccgaccccgttaaacggtaccgggtacccgttccgtaccgggaacggtttacccggtttgaccgttacgtaaccgttacgaaccgggtacccggttaaggtacccggttacgtaccgggttaccctaacgtttaccgtaacgttaacccgttccgtaaccgggcccggttaaacgtacggggtacggtacggttcgggaacggttaaaccggtttacgttaacccgtttccgttttaacccggtttattccccgggtaaacgtaaccggtaaccgtaaaccggtcggtaacgtttaaacgg

SEQ ID NO: 274164 - DNA, 536 bp, Homo sapiens
  misc_feature: GYAE6OF01BZUA4.27.23.C01.1.454.CMB.1.raw
  modified_base (528)..(528): a, c, t, g, unknown or other
  misc_feature (528)..(528): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataacttttatctgttggtaccgacaggacccaggcactgtccccaaactcattctttatgatgtcagtaatcggccccagggtttctgatcgcttctatggctcaagtctgcctacacggcctcctgaccatctccggctccagcctgaggacgagctgattattattgtagttcatatacaaccagtgaactacgttgggtgttcgggcggtagggaccaggcctggaccgtcctaggtcgacgcccaaggcctcgccccctggtccactcctcttcccnccctcccg

SEQ ID NO: 274165 - DNA, 529 bp, Homo sapiens
  misc_feature: GYAE6OF01BJKOD.27.23.C01.1.454.CMB.1.raw
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcacgcccaaggctgccccctcggtcactctcgttcccgccctcccg

SEQ ID NO: 274166 - DNA, 538 bp, Homo sapiens
  misc_feature: GYAE6OF01BIFAQ.27.23.C01.1.454.CMB.1.raw
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtccgtaggtcacggcccaagggctcgccccctcggtccactcctcgttccccacccgtcccg

SEQ ID NO: 274167 - DNA, 527 bp, Homo sapiens
  misc_feature: GYAE6OF01CK60Z.27.23.C01.1.454.CMB.1.raw
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccagggtttctgatcgcttctatggctccaagtctgcctacacggcctccctgaccatctccgggctccagcctgaggacgaggctgattattatgtagttcatatacaacagtgaacacttggtgttcggcgtagggaccaggctgaccgtcctaggtcagtcccaaggcctagccccctcggtcaactctcgttcccacccgtcc

SEQ ID NO: 274168 - DNA, 683 bp, Homo sapiens
  misc_feature: GYAE6OF01B67V3.27.23.C01.1.454.CMB.1.raw
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttgtaccgacaggaccaggcactgtccccaaactcattctttatgatgtcagtaatcggccccaggggtttctgatcgcttctatggctccaagtctgcctacacggcctccctgaccatccgtccgggcctcccgacgtcccgtggacggtacgagggtccttaggtaacttttaatttaacgtttgttaacggtttctaattaacttaaccgaaaccctaagttacgaaccgttaaccgtttgggggttacggtttaccggggcgggtaacggggaacccgtaggggtcccgtacgggtaccccggttcccgtaagggtcccgtaacggaccccgtaaacgggtccctaccgggtccccccccgttcgggttacccttacccgttaccgtttcccgtttccccccgtacccccgttacccccg

SEQ ID NO: 274169 - DNA, 523 bp, Homo sapiens
  misc_feature: GYAE6OF01DY2YF.27.23.C01.1.454.CMB.1.raw
  modified_base (517)..(517): a, c, t, g, unknown or other
  misc_feature (517)..(517): n is a, c, g, or t
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtcccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgcccctcggtcactctcgtcccncctccc

SEQ ID NO: 274170 - DNA, 560 bp, Homo sapiens
  misc_feature: GYAE6OF01DW3VV.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (378)..(378): a, c, t, g, unknown or other
  misc_feature (378)..(378): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtnctttataactttatctgttggtaccgacaggacccaggcactgtaccccaaactcattctttatgatgtcagtaatccggcccctagggtttctgatcgtcttctatggctcaagtctgcctacgacggcctcccngaccatccgtccggctccacgcctggaggacgagctgattattattgtagttcatatacaactagtacgactacgttgggtcgttcggcgggtacgggacaggcgtacgacccgtacctaggtacacggacccgaaggcctcgcccccgtcggtccacttcgtccgttccccgcccttcccg

SEQ ID NO: 274171 - DNA, 565 bp, Homo sapiens
  misc_feature: GYAE6OF01BC3WZ.27.23.C01.1.454.CMB.1.raw
  modified_base (230)..(230): a, c, t, g, unknown or other
  misc_feature (230)..(230): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggccccctaggggtttctgatcgcttctatggctcaagtctgcctacacggccctccngaccatcctccgggcctccagccctggacggacgaggctgtatttattatttgtagttntaatataacaacagtgaactacgttgggtgttccggacgggagggaccgaggcctcgacccgttccgtagggtcgacggcccaagggcctccggccccctggtccacctctcgttccccgcccgttcccg

SEQ ID NO: 274172 - DNA, 534 bp, Homo sapiens
  misc_feature: GYAE6OF01BY2WU.27.23.C01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataactttatctgttggtaccgacaggacccaggcactgtccccaaactcattctttatgatgtcagtaatcggccccaggggtttctgatcgcttctatggctcaagtctgcctacacggcctccctgaccatctccgggctccagcctgacggacgaggctgattattattgtagttcatatacaaccagtgactacgttgggtgtttcgggcggtagggaccaggctggaccgtcctaggtcacgcccaaggctcgcccctcggtcactcctcgttcccgccctccg

SEQ ID NO: 274173 - DNA, 738 bp, Homo sapiens
  misc_feature: GYAE6OF01B7RWR.27.23.C01.1.454.CMB.1.raw
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagagcgtcgtctcacgaccggtgctcgatttagtacacgtgattagggagttgggggggtctcaggaggcacgcgcctcgtcgggtacgtctcctaccattgggcctagggctctgactattcctcaccctcctcactcgaggggtcacagggtcctgggcccagttctgccctgaacttacgagcctgcctccgtgtctgggtctcctggacagtcgagtcacctatctcctgccggactgggaacccgngtatcgacgtttggnactttataactttntctgttcgtacgacaggacccaggcactgtcccaaactcagttcctttatgactcggtacgaggtaactccgggaccccgtaggggtttctcgtactcgtctttctagttggcgtccgtaagtctcgtacccttaacaccggcctacccgtacgtaccctacgtccgtacccggggtccttccgtacgtcccgtacgacgggaacggacggtacttacgtaatttaacttacgtttgttaacgtttacattaactaactaacctaacgtcgtaacctacggttacgggtacggtttccgggacgggtaacgggaccgtacggtacttaccggtaccggttccgtaacgggtaccgtaacggtacccgtaaacgggtaccgttacccggtaccccgttaccgggttaccgtaaccgtttaccgttacccggtttccccggtccccgtttaccccggg

SEQ ID NO: 274174 - DNA, 583 bp, Homo sapiens
  misc_feature: GYAE6OF01AC7AR.27.23.C01.1.454.CMB.1.raw
  modified_base (230)..(230): a, c, t, g, unknown or other
  misc_feature (230)..(230): n is a, c, g, or t
  modified_base (335)..(335): a, c, t, g, unknown or other
  misc_feature (335)..(335): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgctttataacttttatctgttggtaccgacaggacccaggcactgtccccaaactcattctttatgatgtcagtaatcggccccagggtttcngatcgcttctatggctccagtctgcctacacggcctccctgaccatctccgggctccagcctgaggcgaggctgattattattgtagttcatatacaacctagtcgactacgttgggtgttcgggcggtagggaccaggccgtggacccgtccgtagggtcctacggccccgaagggtccctaccggcccccccgttacgggttcccaaccgttcccgttaccggttccccccgtccccgttaccccg

SEQ ID NO: 274175 - DNA, 590 bp, Homo sapiens
  misc_feature: GYAE6OF01BZMWO.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaactccggccccctaggggtttctgatcgcttctatggctccaagtctgcctacgacggccctccctgaccactccgtccgggctcccgagcctggacggacgaggtctgtatttattattgttagttctaatactacaacctagtcgaactacgttgggtgttccgggcggacgggaccaggtctcggacccgtccgtagggtccacggtacccgaaggtcctaccggcccccgttcggtccctaccgttccgttccgttccccacccttcccg

SEQ ID NO: 274176 - DNA, 634 bp, Homo sapiens
  misc_feature: GYAE6OF01BGHVK.27.23.C01.1.454.CMB.1.raw
  modified_base (229)..(229): a, c, t, g, unknown or other
  misc_feature (229)..(229): n is a, c, g, or t
  modified_base (423)..(423): a, c, t, g, unknown or other
  misc_feature (423)..(423): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttaataactttatctgttggtaccgacaggacccaggcactcgtccccaaactcattctttatgatgtcagtaatccggcccctaggggtttctgtatcgtcttctagtcggctccaagtctgccctacgaccggcctcccgtagacccatccgtccgggctccgagtcctggaggacgnggctgtattattattgtagttctatactacaacctagtacgtactacgtttgggtacgtttcgggacgggtacgggacccgagggccgttacggtacccgttccgtaagggttccgaacggtaccccgaagggtcccgtaccgggtcccccccgtttacgggtcccctaaccgttcccgttcccgggtttccccccgccccgtttaccccg

SEQ ID NO: 274177 - DNA, 740 bp, Homo sapiens
  misc_feature: GYAE6OF01DLPRR.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacacggacccaggcactcgtaccccaaactcattctttatgatgtcagtaatccggccccgtagggtttctgatcgtcttctatcggctccaagtctgcctacaccggtccctccctacgaccctactccgtccgggtcctcccgacgcctcggaaggacggaggtctagtaatttaatttagttggttagtttacctaattaactaaaccgtaaaccgtaggttacgtaaccttacggttttacgggggttcgggttttaccggggaccggggtaacgggggtaacccgacggggtacccgttaccgggtaaccccggttaccccgttaacggggttacccgtaaaccgggtaccccccggtaaacggggtccccgttaccccgggtacccccccccgtttaccgggtaccccgttaaccccgttcccgtttacccccggtttccccccctaacccccgtttaccccccgg

SEQ ID NO: 274178 - DNA, 561 bp, Homo sapiens
  misc_feature: GYAE6OF01C6GIJ.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgacggacgaggctgaatttattattgtagttcattatacaacagtcgactacgttgggtgttcgggcgggacgggaccgaggctggacccgtccgtaggtccgacggccccgaaggcctccgcccccctcggtccaccgttcctccggttccccacccttcccg

SEQ ID NO: 274179 - DNA, 523 bp, Homo sapiens
  misc_feature: GYAE6OF01AX1FF.27.23.C01.1.454.CMB.1.raw
  modified_base (483)..(483): a, c, t, g, unknown or other
  misc_feature (483)..(483): n is a, c, g, or t
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctcaagtctgcctacacggcctccctgaccatctccgggctccagcctgaggacgaggctgattattattgtagttcatatacaaccagtgacacgttgggtgttcggcggagggaccaggctgaccgtctaggtcngcccaaggctcgcccctcggtcactctcgttcccgcctcc

SEQ ID NO: 274180 - DNA, 551 bp, Homo sapiens
  misc_feature: GYAE6OF01CPLWY.27.23.C01.1.454.CMB.1.raw
  modified_base (545)..(545): a, c, t, g, unknown or other
  misc_feature (545)..(545): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactcgtaccccaaactcattctttatgatgtcagtaactccggccccgtaggggtttctgatcgcttctatggctccaagtctgcctacacgccctccctgaccactccgtccgggctccacgcctggacggacgaggctgtattattattgtattcatatacaacagtgactagttgggtgttcgggcggagggaccgaggcgtggaccgtccgtaggcacggcccaaggctccgccccctcggtccactctccgttccccncctccc

SEQ ID NO: 274181 - DNA, 577 bp, Homo sapiens
  misc_feature: GYAE6OF01CV713.27.23.C01.1.454.CMB.1.raw
  modified_base (229)..(229): a, c, t, g, unknown or other
  misc_feature (229)..(229): n is a, c, g, or t
  modified_base (333)..(333): a, c, t, g, unknown or other
  misc_feature (333)..(333): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataacttttatctgttggtaccgacaggacccaggcactcgccccaaactcattctttatgatgtcagtaatcggccccagggtttcngatcgcttctatggctaccaagtctgcctacacggcctcctgaccatctccgggctcccagcctgacggacgaggctagatttattattgtagttacatataacaaccagtgaacacgttgggtagtttcgggacgggagggaccagggcctaggcccgttacgtaggtaccgacggcccaaacgggcctccggtacccccctccgggtcaacccttccgtcctttcccccgaaccccttcccg

SEQ ID NO: 274182 - DNA, 548 bp, Homo sapiens
  misc_feature: GYAE6OF01B5L36.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (420)..(420): a, c, t, g, unknown or other
  misc_feature (420)..(420): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttatctgttggtaccgacaggacccaggcactcgtccccaaactcattctttatgatgtcagtaatcggcccctaggggtttctgatcgcttctatggctcaagtctgcctacacggcctccctgaccatcctccgggctccagcctgaggacgaggctgtattattnttgtagttcaatatacaacagtagactacgttgggtgttcgggcggacgggaccaggctggaccgttccgtaggtccacgcccaaggcctcgccccctcggtccactccgtcgttccccgccctcccg

SEQ ID NO: 274183 - DNA, 580 bp, Homo sapiens
  misc_feature: GYAE6OF01BLCNC.27.23.C01.1.454.CMB.1.raw
  modified_base (337)..(337): a, c, t, g, unknown or other
  misc_feature (337)..(337): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtaccccaaactctattctttatgatgtcagtaatccggccccagggtttcngtactcgtcttctagtcggctccaagtctgcctacacggtcctccctgaccacgttccgtccgggctccgacgcctgacggacgaggtctagtattattattgtattcaatactaacaactagtcgactacgttgggtcgttcgggacggtaggaccgaggcgtagtaccgtcgtacggtcacgcccgaacggtcctccgtcccccgtcggtcccacgttccctcgttcccctcccgttcccg

SEQ ID NO: 274184 - DNA, 576 bp, Homo sapiens
  misc_feature: GYAE6OF01DF766.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggagttggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaaccccgngatgacgttggtagcttataactttatctgttggtaccgacaggacccaggcactcgtcccaaactcattctttatgatgtcagtaatcggccccaggggtttctgatcgcttctatggctccaagtctgcctacacggcctccctgaccatctccgggctccgacgcctgaggacgaggctagtattatttattgttagttcattaatacaactagtgaactacgtttgggtgttcgggacgggacgggaccgaggcgtcggaccgtccgtaggtccacggcccaacgggcctaccgtcccccgtcggtccaccttccgttccgttccccgtcccctacccg

SEQ ID NO: 274185 - DNA, 566 bp, Homo sapiens
  misc_feature: GYAE6OF01B48UH.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtaccgacaggacccaggcactgtccccaaactcattctttatgatgtcagtaatccggccccatcgggtttctgatcgcttctatggctcaagtctgcctacacgcctccctgacctatcctccgggctccacgcctgacggacgagctgattattattgtagttcatatacaaccagtcgactacgttgggtacgttcgggcggacgggaccgaggctcggacccgtccgtaggtccgacggcccgaagggcctccggtccccccgttcggtccctaccttccgttccgttcccctaccccg

SEQ ID NO: 274186 - DNA, 557 bp, Homo sapiens
  misc_feature: GYAE6OF01CWIR0.27.23.C01.1.454.CMB.1.raw
  modified_base (229)..(229): a, c, t, g, unknown or other
  misc_feature (229)..(229): n is a, c, g, or t
  modified_base (340)..(340): a, c, t, g, unknown or other
  misc_feature (340)..(340): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgctttataactttatcttgttggtaccgacaggacccaggcactgtaccccaaactcatttctttatgatgtcagtaactcggccccctagggttttcngatcgtcttctatggctcaagtctgcctacacggtcctcctgacctatcctccgggctccagtcctgaggacgaggctgattattattgtagttcatatacaactagtcgaactacgttgggtgttcgggcggacggacgaggctacgtaccgtccgtaggtccgcgaccaaggtctccgcccctcggtaccacgtcttccgtccccaccgttcccg

SEQ ID NO: 274187 - DNA, 558 bp, Homo sapiens
  misc_feature: GYAE6OF01E55MY.27.23.C01.1.454.CMB.1.raw
  modified_base (241)..(241): a, c, t, g, unknown or other
  misc_feature (241)..(241): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggngctttataacttttatctgttggtaccgacaggacccaggcactgtccccaaatcattctttatgatgtcagtaactccggccccctaggggtttctgatcgcttctatggctccaagtctgcctacacggcctccctgaccatcctcccgggctccagcctgaggacgaggctgtatttattattgtagttcattataacaacctagtgactacgttgggtgttcgggcggagggaccaggctggaccgtcctaggtccacggcccaaggcctcgcccccctcggtccaccgttcctcggttccccgcccttcccg

SEQ ID NO: 274188 - DNA, 720 bp, Homo sapiens
  misc_feature: GYAE6OF01CWXSH.27.23.C01.1.454.CMB.1.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatcctcctgcacgtcggaacccgngatggacgtttggngtactttaataacttttatcttggttacggtaccgacgacggacccaggcactcgtaccccaaactctatttctttatgtatgtcaagtaacgtccggccccgtagggtttctaggtactcgtcttactacgtcggtctaccgtaagtctcgtaccctacgaccggtcctccctcgaccctacgtcccgtccgggtcctaccgacgtccgtacgggacgggtaacgacggtaccttaggttaactttaagtttactttacggttagtttacctaattaacgttaaacctaaccgtagttacgaaccgtacggtttggggttacgttacggggaccgggtaacgggaccgtagggtccgtacggtacccgtaccggtacggtacccgacggaccccgtaacggtcccgtaccggtccccccgttacgggtacccttacgtttcccggttcccgttcccccgtccccgttacccg

SEQ ID NO: 274189 - DNA, 731 bp, Homo sapiens
  misc_feature: GYAE6OF01BRBRZ.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttcggtaccgacacggacccaggcactcgtaccccaaactctattctttatgtatgtcagtaactccggaccccgtaggggtttctagtatcgtcttctatcggtactaccaacgtctcgcccttacgaccggtccctccctacgacctacgtccgtccgggtcctccgacgtccgtaggacggaacggtacggtacttacgtaatttaagtttagtttcggtttaagtttacctaagttaactaacctaaaccgtagttacggtaaccttacgggttttggggttacggttccggggaccgggtaacgggtacccgacgggtccgttaccggtaaccccggtttaccggtaacgggttcccgaacgggtacccccgtaaacgggtccccgttacccggtacccccccgttacgggttaccccgtaacccgtttcccgtaccccgttttacccccccgaacccgttccccgg

SEQ ID NO: 274190 - DNA, 663 bp, Homo sapiens
  misc_feature: GYAE6OF01CZ0O5.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (342)..(342): a, c, t, g, unknown or other
  misc_feature (342)..(342): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttatctgttggtaccgacacggacccaggcactcgtaccccaaatctatttctttatgatgtcagtaactccggcccctaggggtttccngtactcgtcttctagtcggtctaccaagtctcgcctacgacggtccctccctcgacctactccgtaccgggcctccgacgccgtggaacggacgaggtcgtagtaactttattagtttgttaacgttcaagttactaaccgtaacgtagtacgtaaccgtacggtttggggtcgtttaccggggacgggtaacgggtacccgagggtccgttacgggtaccccgtccggttacggtccgaccggtacccgaacggtcccgttcccggtccccccgttcgggtccctaccgttccgttcccggttccccgtcccgttacccg

SEQ ID NO: 274191 - DNA, 565 bp, Homo sapiens
  misc_feature: GYAE6OF01DXAZQ.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtaccgacaggacccaggcactcgtccccaaactcattctttatgatgtcagtaatcggcccctaggggtttctgatcgcttctatggctcaagtctgcctacacggcctccctcgaccatccgtccgggctccgagcctgacggacgaggctgatttattattgttagttcatactacaacagtgactacgttgggtgttcgggacggacgggaccgaggctcggaccgtccgtaggtccgacggacccgaaggcctaccgcccccgttcggtccacgttccgtcgttccccgcccttcccg

SEQ ID NO: 274192 - DNA, 655 bp, Homo sapiens
  misc_feature: GYAE6OF01B938D.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttataactttntctgttggtaccgacaggacccaggcactcgtaccccaaactctatttctttatgtatgtacagttaactccggtcccccgtaggggtttcctgtacgtcgtcctttctagttcggcctacctaaggtctacggacccttacgaccggtcccttcccctacgacctacgtcccgtcccgggctccgacgccgtggacggacggagtctggtaactttagttatttagttagttctaattaactaacaactagtacgacgtaggtttgggtcggttacgggcgggtacgggtaaccgaggtccgtacggtaccgttcgtacgtccgacggacccgaacggtcccgtaccggcccccgtacggttcctacccgttccgttcccgttccccgtcccttacccg

SEQ ID NO: 274193 - DNA, 606 bp, Homo sapiens
  misc_feature: GYAE6OF01DMRB4.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgcgatgacgttggtgcttataactttatctgttggtaccgacacggacccaggcactcgtaccccaaactctatttctttatgtatgtacagtaactccggcccccgtaggggtttctgactcgtcttctagtggctccaagtctcgcctacaccggcctccctcgaccactccgtccgggctcccgagtccgtgacggacggaggtctgtatttaatttattagttagttactattaactaactaactaagtacgtacgtacgtttgggtacgttcgggacgggtacgggaccaggcgtacgtaccgtccgtaggtccgaacgccgaacggcgtccgccccctcggtcctacctccttccgttccccgacccctcccg

SEQ ID NO: 274194 - DNA, 599 bp, Homo sapiens
  misc_feature: GYAE6OF01DEICQ.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttatctgttgtaccgacacggaccaggcactcgtaccccaaactctatttctttatgatgtcagtaactccggccccgtaggggtttcctgactcgtcttctatcggctccaagtctgcctacacggtccctccctcgacctatccgtccgggtctccacgcctaggacggacgaggctagtattattattgtacgttcatataacaactagtgtaactacgtttgggtcgttacgggcgggtacgggaccgtaggccgtacgacccgtccgtagggtccgacggacccgaaggccctaccggcccccttacgggtccacgttccgtccgttcccccgcccttcccg

SEQ ID NO: 274195 - DNA, 553 bp, Homo sapiens
  misc_feature: GYAE6OF01DP7DD.27.23.C01.1.454.CMB.1.raw
  modified_base (230)..(230): a, c, t, g, unknown or other
  misc_feature (230)..(230): n is a, c, g, or t
  modified_base (448)..(448): a, c, t, g, unknown or other
  misc_feature (448)..(448): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactcgtccccaaactcattctttatgatgtcagtaactccggcccctaggggtttctgatcgcttctagtgctccaagtctgcctacaccggcctccctgacccatcctccgggctccagccctgaggacgaggctagatttattattgtattcatatacaacagtnactcgttgggtgttcgggcggagggaccaggctcggaccgtcctaggtccacgcccaagggtcctcggcccccctcggtccacttcctcgttccccgccctcccg

SEQ ID NO: 274196 - DNA, 556 bp, Homo sapiens
  misc_feature: GYAE6OF01C1A7R.27.23.C01.1.454.CMB.1.raw
  modified_base (547)..(547): a, c, t, g, unknown or other
  misc_feature (547)..(547): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttatactttatctgttggtaccgacaggacccaggcactgtccccaaactcattctttatgatgtcagtaatcggccccaggggtttctgatcgcttctatggctcaagtctgcctacacggccctccctgaccactcctccgggtctcccgacgccctgacggacgaggctgtacttattattgttagttctatatacaacctagtgactacgttgggtgttcgggcgggagggaccaggctcgaccgtccgtaggtccgagcccaagggcctcgcccccgtcgtccactcctcgttccccncccgtcccg

SEQ ID NO: 274197 - DNA, 611 bp, Homo sapiens
  misc_feature: GYAE6OF01BYV9B.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggncttataacttntctgttggtaccgacaggacccaggcactcgtaccccaaactctatttctttatgatgtcagtaacgtccggcccctaggggtttctgtactcgtcttctatggtctacctaagtctgccctacgaccggtccctccctgacctatccgtccgggctccgacgcctggacggacgaggtctagtactttattattgtagttcaatactaacaaccgagtcgactacgttgggtcgttacgggacggacgggaccagggtcctacggacccgttccgtacggtccgacggtaccccgaagggtccctacccggtccccccgtcgggttccaccgttcctcccgttcccccacccttccg

SEQ ID NO: 274198 - DNA, 541 bp, Homo sapiens
  misc_feature: GYAE6OF01AWU7K.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataactttatctgttggtaccgacaggacccaggcactgtccccaaactcattctttatgatgtcagtaatcggcccccagggtttctgatcgcttctatggctcaagtctgcctacacggcctcctgaccatctccgggctccagcctgagacgagctgattatattgtagttcatatacaactagtgactacgttgggtcgttcgggcggacgggaccgaggctcggaccgtcgtacggtcgacgcccgaaggcctcgccccctcggtccacttctcgttcccgcccgtacccg

SEQ ID NO: 274199 - DNA, 662 bp, Homo sapiens
  misc_feature: GYAE6OF01BFKWJ.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtncttataactttatctgttggtaccgacaggaccaggcactcgtaccccaaactctattctttatgtatgtcagtaactccggcccctaggggtttctgactcgtcttctagtcggctccaagtctgccctacgaccggtccctccctgacctactccgtccgggcctccgacgtcccgtggacggacgaggtctaggtaatttattagttagttagttactaagttaactaactaacctagtacgtaaccgtacggtttggggtcgttaccggggacgggtaacgggtaccgagggtccgtacgggtacccgttaccgtaacgggtccgaacggaccccgtaaacgggtcccttacccggccccccgttacgggtccctaaccgttcccgtttcccggttcccccgtccccgttaccccg

SEQ ID NO: 274200 - DNA, 551 bp, Homo sapiens
  misc_feature: GYAE6OF01DP5DD.27.23.C01.1.454.CMB.1.raw
  modified_base (230)..(230): a, c, t, g, unknown or other
  misc_feature (230)..(230): n is a, c, g, or t
  modified_base (543)..(543): a, c, t, g, unknown or other
  misc_feature (543)..(543): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacagtacccaggcactcgtccccaaactcatttctttatgatgtcagtaatcggcccctaggggtttctgatcgcttctatggctcaagtctgcctacacggtccctccctgaccactctccgggctccgacgccctagacggacgaggctagtatttattattgtagttcattactaacaaccagtcgaactacgttgggtgttcgggcggagggaccaggctcgaccgtctaggtcgacgccaaggcctcgcccctcggtcactctcgtcccncccgtacg

SEQ ID NO: 274201 - DNA, 601 bp, Homo sapiens
  misc_feature: GYAE6OF01BKXGH.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactcgtccccaaactcattctttatgatgtcagtaatccggcccctaggggtttctgatcgtcttctatggctcaagtctgcctacaccggcctccctgaccatcctccgggctccgacgtcctggacggacgaggctagtatttattattgttacgttctaatactactaaccagtcgaactacgtttggggtcggtttccgggacgggtacgggaccgagggtcgtcggacccgttccgtacgggtaccgaccggtaccccgaagggtccctccggccccccgtcggtcctaccgtccgttcgttccccgcttcccg

SEQ ID NO: 274202 - DNA, 743 bp, Homo sapiens
  misc_feature: GYAE6OF01C6E18.27.23.C01.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (352)..(352): a, c, t, g, unknown or other
  misc_feature (352)..(352): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactcggaacccgngatgacgttggtgcttaataactttntctgttggtaccgacaggaccaggcactcgtaccccaaatctattctttatgtatgtcagtaactccgaccccgtagggtttctgactcgcttntagtcggtctacaagtcctgacctacgccggtcccttccgcgtacccacgttcccgtccgggtcctcccgacgccgtagggaaccggaacggacgggtacttaggtaacttttaagtttacgtttaggtttaagttacctaaactttaacctaaaccgtaaccgtaagggttacggtaaaccgttaaccgggttttcgggggttacgggttaccggggtacggggtaacgggacccggtaacggggttaccgtaccggtaaccccggttccggtaacggtacccggaacggtaccccggtaaacgggtcccgtttaccccggtccccccggttaccggttacctaaccccgttcccgtttccccgtttaccccccgtacccccgttccccg

SEQ ID NO: 274203 - DNA, 540 bp, Homo sapiens
  misc_feature: GYAE6OF01BA79K.27.23.C01.1.454.CMB.1.raw
  modified_base (534)..(534): a, c, t, g, unknown or other
  misc_feature (534)..(534): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgtttggtgctttataacttttatctgttggtaccgacaggacccaggcactgtccccaaactcattctttatgatgtcagtaatcggccccagggtttctgatcgcttctatggctcaagtctgcctacacggcctccctgaccatcctccgggctccagcctgaggacgaggctgattattattgtagttcattatacaaccagtgactacgttgggtgttcgggcggagggaccaggctggaccgtccgtaggtcacgcccaaggctcgccccctcggtccactcctcgttcccnccctcc

SEQ ID NO: 274204 - DNA, 791 bp, Homo sapiens
  misc_feature: GYAE6OF01BQ0HT.27.23.C01.1.454.CMB.1.raw
  modified_base (367)..(367): a, c, t, g, unknown or other
  misc_feature (367)..(367): n is a, c, g, or t
tcagagcgtcgtctcacgaccggtgctcgatttagtacacgtgatttagggattggggggggtcgtcaggaggcaggcgccttctccgggacggtctcccaaccgacttcggccttgggctcttgctattcctcaccctcctcactcagggcaccagggtccgtagggtcccgagtcgtgcccttggttaccttctagcccttgtcctaccggtggtcctgggttctccgtggacagtcgattcgaccgagtcggtccgtgtcgactcggaacccgtgggactggacgttgtcgtcttatacttatcgtcgttcggtaccgactacggaccctaggcacttcgtacccaactctactttcgtttacncgtatcgtacgaaggtaacgtccggtaccccggtaggggtttcgtcggtacttaccgtcgttacgtacgtcggacttacgtaagttccgtacggtaccctaaccgtaccggtcccttaccggtacgtaaccgtacgttcccggtaccggggtaccttacccgtaccgtcccgttacgggtacgggaaccggtacgggaaccttacggtaactttaagtttaactttacgttaacgttactaacgttactaacaacgtacgtacgaccgtaacggttcgggtacgttaccgggacgggtacgggtaccgacgggtccgttacggttaccgttaccgtaggtcgaccggtacccgaacgggtcctacccggtaccccggttacggtcctaccggttaccgtcccggttaccccgcccgttaccccg

SEQ ID NO: 274205 - DNA, 692 bp, Homo sapiens
  misc_feature: GYAE6OF01AULO4.27.23.C01.1.454.CMB.1.raw
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttntctgttggtaccgacaggacccaggcactgtccccaaactcattctttatgatgtcagtaactcggcccctagggtttctgatcgtcttctatcggtctcaagtctcgcctacaccggtccctccctcgacctactccgtcccgggcctccgacgtcccgtaggacggtacgaggtcgtagtaatttagttagtttggttacgttacaagttaactaacctaacctaagtacgtaacctacggtttggggtcggtttaccggggacggggtacgggaacccgtagggtccgttaccggtacccggttaccgttaacgggtaccgaaccgggtaccccgtaaacgggtccccgttacccgggtaccccccccgttcgggttaccccgtacccgtttcccggtttaccccggtttccccccggtcccccgttaccccgg

SEQ ID NO: 274206 - DNA, 687 bp, Homo sapiens
  misc_feature: GYAE6OF01DUZ0N.27.23.C01.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgccactcggaacccgngatgacgttggncttataactttntctgttggtacgacaggaccaggcactcgtaccccaaactctatttctttatgatgtcagtaactccggcccctagggtttctgatcgtcttctatcggtactactaacgtctgtccctacgaccggtcctccctgaccctagtccgtcccgggctaccgacgtccgtggacggtacgaaggtctagtaactttagtttactttagttacgttactaagtaacttaaccaaccgtaggtcgtaaccgtacggtttacgggttcggttcgggaaccgggtacggggtaaccgtacgggtaccgttaccggtacccggttaccgttaacgggtaccgaccgggtaccccggaaacggttcccgtacccggtccccccgttccggtacccgttacccgttaccggtttcccgttccccccgccccgttaccccg

SEQ ID NO: 274207 - DNA, 629 bp, Homo sapiens
  misc_feature: GYAE6OF01BK9M4.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttatctgttggtaccgacaggacccaggcactgtccccaaactcattctttatgatgtcagtaactcggccccgtaggggtttctgtatcgtcttctatcggctcaagtctcgcctacacggtccctccctgacctatccgtccgggtcctccgacgccgtacggacggacggtaggcctagtaatttacgttatttcggttagttctaagttactacaacctagtacgaacgtacgtttgggtacggttcgggacggtacgggaccgacggtccgtacggaccgtccgttaagggccgacggtaccccgaagggtccgtccggtaccccctccgggtacctaccgttaccgttccgttcccccgtcccgttccccg

SEQ ID NO: 274208 - DNA, 583 bp, Homo sapiens
  misc_feature: GYAE6OF01E0FQW.27.23.C01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttntctgttggtaccgacaggacccaggcactcgtccccaaactcattctttatgatgtcagtaatccggcccctaggggtttctgtatcgcttctatggctcaagtctgcctacaccggcctccctgacctatccgtccgggcctccacgcctggacggacgaggctgtatttattattgtagttcattataacaaccagtgactacgttgggtgttcgggacggaggaccgaggtcctaggtacccgttccgtaaggtccgacggcccgaacggccgtccggtcccccgtcggtccctaccgttccgttccgttcccccgcccttcccg

SEQ ID NO: 274209 - DNA, 704 bp, Homo sapiens
  misc_feature: GYAE6OF01DCN9W.27.23.C01.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattggggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatggacgtttggncttataactttntctgttggtaccgacacggacccaggcactcgtaccccaaactcattctttatgatgtcagtaatccggccccgtaggggtttctgatcgtcttctagtcggtctccaagtctgaccctacaccggtccctccctgaccctacgttccgtcccggggtcctcccgacgcccgttaggacgggacggagggtcctaggtaattttaattagtttggttaacgttctaagttaactaaccgaacctagtacgaaccgtacggtttggggtacggtttcggggaccggggtaacggggtacccgtacgggtaccgttaccggtacccggttacccgttagggtacccgtaaccgggtaccccgaaacgggtcccgttacccggtcccccccgttcgggttacccctaacccgtttcccgttcccggttcccccctacccccgttaccccgg

SEQ ID NO: 274210 - DNA, 554 bp, Homo sapiens
  misc_feature: GYAE6OF01B7VV2.27.23.C01.1.454.CMB.1.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (546)..(546): a, c, t, g, unknown or other
  misc_feature (546)..(546): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggngcttataactttntctgttggtaccgacaggacccaggcactgtccccaaactcattctttatgatgtcagtaactcggcccctagggtttctgatcgcttctatggctcaagtctgcctacacggcctccctgaccatcgtccgggctccgacgcctggacggacgaggctagtatttattagttgttagttcattataacaaccagtgactacgttgggtgttcgggcgggagggaccgaggcgtgaccgtctagggtcacggcccaaggctccgccccctcggtccactcctcgttccccnccctcccg

SEQ ID NO: 274211 - DNA, 655 bp, Homo sapiens
  misc_feature: GYAE6OF01EXDJW.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatggacgttggtgacttaataacttttatctgttggtaccgacgaggacccaggcactcgtaccccaaactctatttctttatgatgtcaagtaacgtccggccccgtagggtttctgacttcgcttctatggctacaagtctcgcctacgaccggtccctccctcgaacctactccgtcccgggtctcccgacgtccgtaggacggaccggaggtcttaggtaatttatttagttgttaacgttactaagttaataaccaaccgtagtacgaacgttacgttgggttacggttcgggacgggacggtaccgagggtccgtacggtacccgtccgtaggtcccgtacggacccgacggtcctaccggtcccccctacgggttccctacccgttaccgttcccggttcccccgccccgttacccg

SEQ ID NO: 274212 - DNA, 768 bp, Homo sapiens
  misc_feature: GYAE6OF01CZT07.27.23.C01.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcacgtggaacccgngatggacgtttggtnctttaataactttatctgttcggtaccgacgacggaccaggcactcgtaccccaaactctatttctttatgtatgtcagtaactccggccccgtagggtttctgtactcgtcttctagtcggtctacgaagttctcggtaccctaacgaccggtccctaccctacggtacccgtacgttcccgtacccgggtcctacccgaacggtcccgtagggaacgggaccggacggtccgttaggtaacttttaagtttacgttttacggttaagtttaccaaagtttaacttaaacccaaaccgtaagttacggtaacctaacgggttttcggggttacgggtttaccggggaccggggtaacggggtacccgtaaggggtccgttacgggtaaccccgggttccgttaacgggttcccgaaccgggtaccccgtaaacgggtcccgttaccccggaccccccggtttaccgggtcccttaacccgttcccgtttaccccggtttacccccgtaccccgtttaccccg

SEQ ID NO: 274213 - DNA, 639 bp, Homo sapiens
  misc_feature: GYAE6OF01DP120.27.23.C01.1.454.CMB.1.raw
  modified_base (231)..(231): a, c, t, g, unknown or other
  misc_feature (231)..(231): n is a, c, g, or t
  modified_base (456)..(456): a, c, t, g, unknown or other
  misc_feature (456)..(456): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatgacgttggtgcttaatactttatctgttcgtaccgacacggacccagcactcgtacccaaactctattctttatgatgtcaagtaacgtccggccccgtaggggtttcagtactcgtcttctagtcgtacctactaagtcctcgacccttaacgaccggtcccctcccgtcgaaccctacgttccgtcccgggtcctaccgacgtccgtaggacgggaacgnggtctagtaatttatttagtgtttacgttctaagttaactaaccaacgtagttacgaacgtacggtttacgggttgttcggggacggacgggaccgagggctacggtaccgtccgtaggccgacgcccgaaggtcctccgtcccccgtacggtcctacgtccgttccgttccccgtccctccg

SEQ ID NO: 274214 - DNA, 744 bp, Homo sapiens
  misc_feature: GYAE6OF01APUXT.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcacatctcctgcactggaacccgngatgacgttggnctttataactttntctgttggtaccgacaggacccaggcactcgtaccccaaatctatttctttangatgtcagtacgtccggccccgtaggggtttccngtactcgtcttcgtagtcggtcctacctaacggttctcgtacccttacgtacccggtccccttcccgtacgtaacccctacgttcccggtcccgggtccttcccggaacgtccctagggaacgggtaacggacggtacgttaggtaacttttacgtttaagtttcggttaagtttacctaattaacttaaccctaaccgtaggttacgtaacccgtaaggtttcggggttacggttacgggaccgggtaagggacccgtaggtccgtacggtacccgtaccggttacgggaccgtaccgggtacccgaacgggtccccgttacccgggtaccccccgttcgggttaccctaccccgttacccgggtttccccgtttaccccccgtaacccccgtttccccg

SEQ ID NO: 274215 - DNA, 573 bp, Homo sapiens
  misc_feature: GYAE6OF01B2PVU.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggaccaggcactcgtccccaaactcattctttatgatgtcagtaatccggcccctaggggtttctgatcgcttctatcggctaccaagtctgcctacacggccctccctgaccatcctccgggctccagcctgaggacgaggctagtatttattattgtagttcatatacaacagtgactacgttgggtcgttcgggacggagggaccgaggtcgtcggaccgttccgtagggtaccacggtcccgaacggcctccgtcccccgtcggtacctaccttccgtccgttccccgacccgttccc

SEQ ID NO: 274216 - DNA, 542 bp, Homo sapiens
  misc_feature: GYAE6OF01B24PR.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttntctgttggtaccgacaggacccaggcactgtccccaaactcattctttatgatgtcagtaatcggccccagggtttctgatcgcttctatggctccaagtctgcctacacggcctccctgaccactctccgggctccacgcctgaggacgaggctagatttattattgtagttcatatacaacagtgactacgttgggtgttcggcggacgggacaggctcgaccgtccgtaggtcacgcccgaaggcctccgcccctcggtccactcgtcgttccccgccctcccg

SEQ ID NO: 274217 - DNA, 846 bp, Homo sapiens
  misc_feature: GYAE6OF01DVR2S.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgactttataacttttatctgttcggtaccgacgacggaccaggctactcgtaccccaaatctaattcttatgatgtacagtaacgtccggtacccgtagggtttctgtactcgtcttactagtcggtacctaccgaacgttctacgtaccctacggaccgtcccttacccgtagaaccctccgttccggtcccgggtaccttacccgacggtacccgttaggggaaaccgggtacggaacggtaccgtttaggttaaactttttaacgtttaaggttttacgttaaacgttttacctaaaacgttaaccttaaacccgaaaaccggttacggttaacggttaacccggtttaaccgggtttcggggggtttaccggggtttaaccggggacccggggttaaacggggtaaccccgtagggggttacccgttaaccgggtaccccgggtttaccgggttaaaacgggttcccggaaaccccgggtacccgtaaacggggttccccccgttaccccggttccccccgggttaacccggttccccgttaaccggtttacccccgtttaccccggtttaccccccccgaaccccggttttaacccccg

SEQ ID NO: 274218 - DNA, 541 bp, Homo sapiens
  misc_feature: GYAE6OF01DIXYV.27.23.C01.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (534)..(534): a, c, t, g, unknown or other
  misc_feature (534)..(534): n is a, c, g, or t
tcagagcgtcgtctcacgaccggtgctcgatttagtacacgtgattagggattggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaacccncgatgacgttggtncttataactttatctgttggtaccgacaggacccaggcactcgtccccaaactcattctttatgatgtcagtaatcggccccaggggtttctgatcgcttctatggctccaagtctgcctacacggcctccctgaccatccgtccgggctccagcctgaggacgaggctgtattattattgtagttcatatacaacagtgactacgttgggtgttcgggacggagggaccgtaggctcgaccgtccgtaggtcacgcccaaggcctcgcccctcggtcactctcgtcccncccgtcc

SEQ ID NO: 274219 - DNA, 739 bp, Homo sapiens
  misc_feature: GYAE6OF01D753P.27.23.C01.1.454.CMB.1.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
tcagagcgtcgtctcacgaccggtgctcgatttagtacacgtgattagggagttggggggggtctcacggaggcagcgactcgtcggggacgttctcctaccgatggcctgggctctgactattcctcaccctcctcactcgagggtcacagggtccttggggtcccaggttctgtcccttaggacttcacgcctgcctacgtgtctgggtctcgtggacngggtcgatcaccatcctcgtgcactggaaccntatcgacgttggctacttacttaacttgtctcgttcggtacgtacgacggaccgaggctacgtcgtaccctaacgtcctacttacttactggtactggtactaggtacgtccggcccgtagggttctgtctcgtcttgtagtcgtctacgtaacgtctcgtcctacgaccgtcctcccgtcgtaccgtacgtccgtccggtctaccgacgtccgtacggacggtaacgacggtacgtaagtaacttaacttacgttaggttacgttactaacgttaacctaacgtaactaggtaccgtaacgttaccgggttagggtacgggttaccggacggggtaacggtaccgtacgggtaccgttacgggaacccggtacgggtaacgggtaccgaaccgggtacccggtaacggtcccgtacccggttacccccgttacggttaccgtaacccgttcggttaccccgggttccccgaccccggttacccgg

SEQ ID NO: 274220 - DNA, 625 bp, Homo sapiens
  misc_feature: GYAE6OF01EBAR9.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttatactttatctgtggtaccgacaggacccaggcactcgtaccccaaactctatttcttatgatgtctagtaactccggcccccgtaggggtttctgatcgcttctatggctcagtctcgcctacgaccggtccctccctcgaccacgtccgtacccgggtccttacccgacgtcccgtggacgggacggtaggtcctgtaatttattagttgttacgttctatactaactaacctagttcgaactacgttggggtcgttcgggacgggagggacccgagggtcgtacggtaccgtccgtagggtccgacggtacccgaaggtccgtccggtccccccgttcgggtacctaccgttccttccgttcccctcccgtacccg

SEQ ID NO: 274221 - DNA, 878 bp, Homo sapiens
  misc_feature: GYAE6OF01DR0HB.27.23.C01.1.454.CMB.1.raw
  modified_base (402)..(402): a, c, t, g, unknown or other
  misc_feature (402)..(402): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatcctcctgcacgtcggaacccgcgattggacggtttggtcgtaccttttaattaaaccttttatccgttaggtttacgggtaacccggaacgaacgggaccccagggcctaccgttacgtacccccaaacttctaacttttctttatgtattcgtactaacgtaacgtcccggtccccgttagggttttcngtacttccgtctttcgtacgtcggaccttaccgtaagttccgtacgacccttaaccggaccggtcccttcccgtacgaacccttacgttcccggtacccggggtcctacccgtaacggtcccggttacgggaacgggtaaccggtacgggtctttaacggttaatttttaagtttacgtttacggtttaacgtttacctaaagtttaaccgttaaaccgtaaacccgttaagttaccgtaaccggtttacgggtttacgggggtttacggttacccgggggaacgggggtaaccgggtaacccggtacggggtacccgttaacgggttacccccggttaccggttaacgggtacccgtaacccgggtaccccggtaaccgggtccccgtttacccccgggtaccccccggttaccgggttccccttacccggtttacccgtttcccccggttaccccccgtccccgttacccccgg

SEQ ID NO: 274222 - DNA, 606 bp, Homo sapiens
  misc_feature: GYAE6OF01CSKPU.27.23.C01.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (373)..(373): a, c, t, g, unknown or other
  misc_feature (373)..(373): n is a, c, g, or t
tcagagcgtcgtctcacgaccggtgctcgatttagtacacgtgattagggagttggggggggtctcaggaggcaggcgcctcgtcgggacgtctccaccagtggcctgggctctgctattcctcacccgtcctcgactcgagggcacagggtcctgggcccagtctgccctgactcagcctgcctccgtgtctgggtctcctggacagtcgatcaccatctcctgcactggaacccngatgacgttggncttataacttatctgttggtaccganaggacccaggcactcgtaccccaaatcatttctttaatgatgtcaagtaactcggcccctagggtttctgatcgtcttcatggctcaagtctgctacncggcctcctgacctatccgtcggctaccgacgcctagacggacgacggtctaggtaatttattagtttagtagtttacaattatacgaacctagtcgaactacggttgggttacgttcgggacggacggtacgagggtctacggaccgtccgtaaggtccgaacgcccgtaaggcctaccggtcccccgttacggtccctaaccttccgttccgttcccccacccgttacccg

SEQ ID NO: 274223 - DNA, 710 bp, Homo sapiens
  misc_feature: GYAE6OF01CTVJI.27.23.C01.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (362)..(362): a, c, t, g, unknown or other
  misc_feature (362)..(362): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctggcccagtctgccctgactcagcctgcctccgtgtctgggtctcctggacagtcgatcaccatctcctgcacgtcggaacccgngatggacgtttggtnactttaattaactttatcgttgttcggtaaccgacgacggacccaggaccacgtacgtaccccaaactctaatttctttatcgatcgtacagtaactccggccccgtagggtttccngtactcgtcttctagtcggctaccgtaagtctcgtacctaaccgaccggtcccttcccgtacgaccctacgtcccgtccgggtccttaccgacgtccgtaggacggacgtacgtactagtaatttacgtttagttaggttacgtttacaattaacgtaacctaaacgtagttacgtaacgttacggtttacggggttacgttaccggggacgggtaacgggaccgtagggaccgttacggacccgttaccggtaagggtccgtaaccggtacccgaacggtcccgttcccggacccccgttcgtacccgttacccttcccgttcccgtacccccgtcccgttaccccg

SEQ ID NO: 274224 - DNA, 844 bp, Homo sapiens
  misc_feature: GYAE6OF01BVSAN.27.23.C01.1.454.CMB.1.raw
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcgaccatctccgtgccacgtggaaccccgcgagtcgaccgtttggtgctttataacttttatctgttggtaccgacaggacccaggcactcgtccccaaactcattctttatgatgtcagtaacgtccggcccccgtaggggtttctggactcggtcttcgtagtcggtcttaccgtaagttcctacgcccttaaccgaccgggtccccttaccccgtacgtaaccctaacgttcccgttacccggggtccttacccgaacggtcccgttagggaacgggaacccgggtaacgggtaccttacggttaaacttttaacgttttaacgtttacggtttaacggtttacctaaactttaaaccgttaaacccgtaaacccgtaacggttacggtaaaccgttaacccgggtttttacgggggttaccgggttttaacccgggggaccgggggttaaccggggaaccccgtacggggtacccgttacgggtaaccccgggttacccggttaacggggttacccggaaccgggtacccccggtaaacggggtcccttacccgggtaccccccccggttacgggttacccgtaacccgtttacccggtttacccggtttccccccgtaccccccgttaccccgg

SEQ ID NO: 274225 - DNA, 772 bp, Homo sapiens
  misc_feature: GYAE6OF01CCJ9A.27.23.C01.1.454.CMB.1.raw
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatgacgttggtgcttataactttntctgttggtaccgacgacggaccaggcactcgtaccccaactcatttctttatgtatgtcaagtaacgtccggccccgtagggtttctgactcgtcttcgtatcggcctacctaagttcctcgtccctaaccgaccggtcccttaccctacgacctacgttccgtcccgggtccctcccgaacgtccgtacggaacgggaccggtaggtccttagttaacttttaagtttacgtttaggttaacgtttactaattaaccgttaaacccaacccgtaaggttacgtaaccgttaccggtttggggttaccgggtttacggggacggggtaaccgggacccggtaacgggtccgttacgggtacccggttacccgttaacggggttacccgaaccgggtacccccggtaaacgggtccccgtttacccccgggtacccccccggttacccggggttaccctaacccgttttccccgttcccggttttaccccccccgtaacccccgttttacccccgg

SEQ ID NO: 274226 - DNA, 564 bp, Homo sapiens
  misc_feature: GYAE6OF01BBTEF.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccctaggggtttctgatcgtcttctatggctccaagtctgcctacaccggcctccctgaccatcctccgggctccagcctgacggacgaggctgattattattgtagttcattataacaacctagtcgactacgtttgggtcgttcgggcggacgggaccaggctgaccgtccgtaggtccgacgcccgaaggcctccggcccccttcgggtcctaccttcctccgttccccgcccgttcccg

SEQ ID NO: 274227 - DNA, 791 bp, Homo sapiens
  misc_feature: GYAE6OF01EBNUN.27.23.C01.1.454.CMB.1.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
tcagagcgtcgtctcacgaccggtgctcgattttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctctgcactggaacccgngatggtacgttgntacttaatactttntcgtggtacggaccgacgacggacccgaggcnctacgtaccccaaattcttatttnttatgtagtgtacacggtaaccgtcccgggtacccgttagggttctcgactcttacttacgtacggtcgttaccgtacgtacgttcggtccctaacccgtaccggtacccttaccccgttcggaaccctaactaccgtccccgggtaccgttcccaaccggtcccgttacgggaacggggtaacgggtacgggtaccgtacgtaagtttaactttaacgttttacgtttaacgtttaaccgtaaacgtttaagttaaaccctaaaccgttaaacggttaggtaaccgttaaccggtttagggggttccggttaccggggtaccggggtacggggtaacccgtacgggtacggtccggttaaccgggttacccgttacgggtacgacggtaaccccgaacgggtacggttcccggaccccccggttccggtccgtaccttacccgttcccgttccccttaccccgtcccttaccgg

SEQ ID NO: 274228 - DNA, 571 bp, Homo sapiens
  misc_feature: GYAE6OF01ESOB2.27.23.C01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaacccngatgacgttggtgcttataactttatctgttggtaccgacacggacccaggcactgtacccccaaactctatttctttatgtatgtcagtaactccggcccctaggggtttctgatcgtcttctagtcggctaccaagtctgccctacgccggtccctccctcgacctatccgtccgggcctccgacgtccctaggacggacggaggtctgtattattattgtagttcatactacaacagtgactagttgggtgttcgggcggagggaccaggtcgtcgaccgtcgtaggtcgacgaccaaggtcctcggcccctcggtcctactcctcgtcccctccgtccc

SEQ ID NO: 274229 - DNA, 773 bp, Homo sapiens
  misc_feature: GYAE6OF01EKQK2.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgtcttaataactttatctgttggtaccgacaggacccaggcactcgtaccccaaactctattctttatgatgtcagtaactccggccccgtaggggtttctgtactcgtcttctagtcgctccaagtctcgcctaccgaccggtccctcccgtcgaccctacgtccgtcccgggtcctaccgacgtcccgttagggacgggtaccgggtacggtcgttacggttaacttttaacgtttaagttttacggtttaacggtttacctaaatttaaccttaaacccgtaaacccgtaaggttaacggtaaccgttaaccgggtttacgggggttacgggtttaccgggggaccggggtaacgggggtaacccgtacggggtacccggttaccggtaaccccgggtttacccggttaacgggttacccgaaccgggtaccccgtaaacggggtccccgtacccgggtcccccccgtaccgggttaccctaacccgtttccccgttcccggtttccccccgtcccccgttaccccg

SEQ ID NO: 274230 - DNA, 565 bp, Homo sapiens
  misc_feature: GYAE6OF01D4ZKG.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgctttataactttatctgttggtaccgacaggacccaggcactgtccccaaactctatttctttatgatgtcagtaactccggcccctaggggtttctgatcgcttctatggctcaagtctgcctacacggcctcctgaccatccgtccgggctccgagcctgaggacgaggctgattattattgtagttcatactacaaccagtgactacgttgggtgttcggcggagggaccaggtctgacccgttcgtagggtcaacggcccgaaggtcctccggccccccgtcgggtcctaccgttcctccgttcccccacccttcccg

SEQ ID NO: 274231 - DNA, 603 bp, Homo sapiens
  misc_feature: GYAE6OF01BC2LJ.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgtatgtcagtaactccggcccccgtaggggtttctgtatcgtcttctagtcggctccaagtcctgcccttacaccggtccctccctcgacctactccgtcccgggctccgacgtcccgtaggacgggacgaggccttgtaactttattatttgttagttcaagtatacaacagtgactacggttgggtgttcgggacggagggaccgaggtctggacccgtccgtaggtccacggacccaaggccgtaccgcccccgttggtaccctacgttccttcccgttccccaccccgttcccg

SEQ ID NO: 274232 - DNA, 656 bp, Homo sapiens
  misc_feature: GYAE6OF01DZCSG.27.23.C01.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccntctcctgcactggaacccngatgacgttggngcttataactttntctgttggtaccgacaggacccaggcactgtcccaaactctattcttatgatgtcagtaatcggcccctagggtttctgatcgcttctagtggctcaagtctcgctacacggtcctcctgacctatccgtccgggtctccgacgtcccgtaggacggaccgtaggtctaggtatttacgtttagtttgttaacggtttcctaacgttaacgttaaccctaaaccgtaggttacgtaaccgttacgtttacggggtacgtttccgggaccgggtacgggtaacccgtacgggtcctacgggtaccccgttccgttaagggtccgaaccggtcccgaaacgggtccttaccggcccccgttacgggtcctaaccgttcccgttacgttcccccgcccttacccgg

SEQ ID NO: 274233 - DNA, 701 bp, Homo sapiens
  misc_feature: GYAE6OF01D0JCD.27.23.C01.1.454.CMB.1.raw
  modified_base (232)..(232): a, c, t, g, unknown or other
  misc_feature (232)..(232): n is a, c, g, or t
  modified_base (361)..(361): a, c, t, g, unknown or other
  misc_feature (361)..(361): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacgagggtcctgggcccagtctgccctgactcagcctgcctccgtgtctgggtctcctggacagtcgatcaccatctcctgcacgtcggaacccgngatcggacgttggtgactttaataacttttatcgttaggttcggtaaccgacacggacccaggcctaacgtcgtaccccaaatctatttctttatgtatgtacaagtactccggacccgttagggttcngtactcgtcttctagtcggtctacgacgttcgtacgtccgtaacacccggtccctcccgtacgaaccctacgtccggtcccgggtacctccgaacgtccgtacgggacggaacggtacggtcttagtatttagtttagtttagttacgttactaacgttaactaaccgtaaccgtagtacgtaacggttcggttaggggtcggttacgggacgggtacgggtaccgtagggtcgtaccggtaccgttccggtacggtaccgaaccggacccgaacggtcccgtcccggtacccccgttcggtccctaccgttccgttcccgttccccgtcccgttacccg

SEQ ID NO: 274234 - DNA, 532 bp, Homo sapiens
  misc_feature: GYAE6OF01CMTOQ.27.23.C01.1.454.CMB.1.raw
  modified_base (465)..(465): a, c, t, g, unknown or other
  misc_feature (465)..(465): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccagggtttctgatcgcttctatggctccaagtctgcctacacggcctcctgaccatctccgggctccagcctgacggacgaggctgatttattattgtattcatatacaacagtgacacgttgggtgttcggcggagggaccngggctggaccgtcctaggtcacggcccaaggcctcgccccctggtccactctcgttcccgcccttcc

SEQ ID NO: 274235 - DNA, 557 bp, Homo sapiens
  misc_feature: GYAE6OF01BNBRC.27.23.C01.1.454.CMB.1.raw
  modified_base (229)..(229): a, c, t, g, unknown or other
  misc_feature (229)..(229): n is a, c, g, or t
  modified_base (332)..(332): a, c, t, g, unknown or other
  misc_feature (332)..(332): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataactttatctgttggtaccgacaggacccaggcactgtccccaaactcattctttatgatgtcagtaatcggccccagggtttcngatcgcttctatggctcaagtctgcctacacggcctccctgaccatcctccgggctccgagccgtagacggacgaggctgtatttattattgttagttctatatacaactagtacgactacgttgggtgttcgggcgggtaggaccgaggcctggaccgtccgtaggtcgacgtcccgaaggtcctccggcccctcggtccacgttctccgttcccgccctcccg

SEQ ID NO: 274236 - DNA, 755 bp, Homo sapiens
  misc_feature: GYAE6OF01C0JFR.27.23.C01.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatggacgttggtntctttattaactttatcttgttcggtaccgacgacggacccaggcactcgtaccccaaactctatttctttatgatgtcagtaacgtccggaccccgtaggggtttctgtactccgtcttctagtcggctaccaacgtctcgccctaccgaccggtccctcccgtcgtacctacgttcccgtccgggtccttcccgacgtccgtacgggacgggaaccggaggtctaggtaacgttttaatttacgtttaggttaacgtttactaactttaacgtaaacctaaaccgtacgggttacgaaccgttaacgggttttcggggttaccgggtttccgggggaaccggggtaacggggtacccgtaggggttacccgttacgggtaacccggttacccggttacgggtaccgtacccggaccccggtaacgggtccccgttacccggtcccccccggttacggtccccgtaacccgttcccgttccccggtttcccccacccccgtttaccccg

SEQ ID NO: 274237 - DNA, 697 bp, Homo sapiens
  misc_feature: GYAE6OF01BTUYX.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaacccgngatgacgttggtnctttaataactttntctgttggtacgacaggaccaggcactcgtaccccaaactctatttctttancgtatgtcaagtaacgtccggaccccgtaggggtttcctgtactcgtcttcgtagtcggctactaagtctacgtcctacgaccggtccctcccgtacgaacctacgtccgtcccgggctaccgacgtccgtaggacggacggaggtacgttagtatttacttagtttcggtaacgtttacaagttaactaacaacgtacggttagaacgttacggttgggttacggttcgggacgggtaacgggaaccgtacgggtaccgttacggtacccgttacccggtaagggttacccgaaccggtaccccgtaaacgggtcccgttacccggtccccccggttacggtaccctaccgtttcccgttacccgttacccccgtacccccttacccg

SEQ ID NO: 274238 - DNA, 590 bp, Homo sapiens
  misc_feature: GYAE6OF01BQ91Q.27.23.C01.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (581)..(581): a, c, t, g, unknown or other
  misc_feature (581)..(581): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtncttataactttntctgttggtaccgacaggacccaggcactcgtccccaaactcatttctttatgatgtcagtaactccggcccctaggggtttctgtactcgtctttctagtcggcctaccaagttctcgccctaaccgaccggtccctcccgtgaccctattcccgtccgggccttccgacgtcctaggacggacgaggtctagtatttattagttgttacgttctatactacaacagtgaactgttgggtgttcgggcggacgggacaggctgaccgttcgtaggtcacgccgaaggcctccgccccttcggtcctacgttccttccgttccccncccgtcccg

SEQ ID NO: 274239 - DNA, 560 bp, Homo sapiens
  misc_feature: GYAE6OF01ET26G.27.23.C01.1.454.CMB.1.raw
  modified_base (373)..(373): a, c, t, g, unknown or other
  misc_feature (373)..(373): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataacttttatctgttggtaccgacaggcccaggcactgtccccaaactcattctttatgatgtcagtaatcggccccagggtttctgatcgcttctatggctcaagtctgcctacacggctcccngaccatctccgggctccagcctgaggacgaggctagatttattattgtagttctatatacaaccagtacgactacgtttgggtacggttcggcgggacgggaccaggtcctggacccgtcgttaaggtccgtacgacccaaggcctacgcccccgtcggtcacttcctcgttccccgcccttacccg

SEQ ID NO: 274240 - DNA, 593 bp, Homo sapiens
  misc_feature: GYAE6OF01D07NN.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgtcttaataactttatctgttggtaccgacaggacccaggcactcgtaccccaaactctattctttatgatgtcagtactccggcccctagggtttctgactcgtcttctatcggctacaagtctcgcctacgaccggtccctcccgtcgacctatccgtccgggctccagcccgtagacggacgacggctagtaatttattatttgtagttcaattactacaacctagtgaactcgttgggtgttcgggcggacggaccgaggtctacggaccgttcgtaggtcgacgacccgacggtcctaccgtcccccgtcggtcctacttcccgttccgtccccgtcccttcccg

SEQ ID NO: 274241 - DNA, 584 bp, Homo sapiens
  misc_feature: GYAE6OF01DWI4J.27.23.C01.1.454.CMB.1.raw
  modified_base (229)..(229): a, c, t, g, unknown or other
  misc_feature (229)..(229): n is a, c, g, or t
  modified_base (435)..(435): a, c, t, g, unknown or other
  misc_feature (435)..(435): n is a, c, g, or t
  modified_base (576)..(576): a, c, t, g, unknown or other
  misc_feature (576)..(576): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgctttataactttatctgttggtaccgacacggacccaggcactcgtaccccaaactctatttctttatgtatgtcagtaactccggccccgtaggggtttctgtactcgtcttctagtggctaccaagtctgaccctacgccggtccctccctcgacctactccgtccgggctccacgcctaggacggacgnggctagtatttattattgttagttctattactacaacctagtgaacgtcgttgggtcgttcgggacgggagggacgaggcgtcgaccgtcgtaggcgacgacccaggtcctaccgcccctcggtcaccttctccttccccnccgttccc

SEQ ID NO: 274242 - DNA, 593 bp, Homo sapiens
  misc_feature: GYAE6OF01B7YVT.27.23.C01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttntctgttggtaccgacaggacccaggcactcgtaccccaaactcattctttatgatgtcagtaactccggccccgtaggggtttctgatcgcttctatggctcaagtctcgcctacaccggccctccctcgacctatccgtcccgggctccgacgcctggacggacgaggtctagtatttattattgtagttctaattactaacaacgtagtacgactacgttgggtcgttcgggacgggtacgggaccgagggctcggaccgtccgtaggtcgacggacccaagggtcctccggcccccgttcggtccaccttccttccggttccccgtcccttcccg

SEQ ID NO: 274243 - DNA, 677 bp, Homo sapiens
  misc_feature: GYAE6OF01B7283.27.23.C01.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgtaacccgngatgacgttggtgcttataacttntctgttgtaccgacaggaccaggcactcgtaccccaaatctaatttctttatgtatgtactagtaacgtccggaccccgtaggggtttctgtactcgtcttctacgtcggtacctaccgtaagtcctcgtacccctaaccgaccggtcccttacccctcgaacctacgtcccgtacccgggccttccgacgtccgtaggacgggacggagtcgtaggtaactttattagttggttacttacattaactaacctaacgtagttacgtaacgtacggtttgggtacgttcgggaccgggacgggaccgtacgggccgttacggaccgttccgtaacggtcgaaccggcccgaacggtcccgtcccggtccccccgttcggtacctacccgttacccgtcccgtttcccccctaccccgttacccg

SEQ ID NO: 274244 - DNA, 569 bp, Homo sapiens
  misc_feature: GYAE6OF01B56VR.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (549)..(549): a, c, t, g, unknown or other
  misc_feature (549)..(549): n is a, c, g, or t
  modified_base (563)..(563): a, c, t, g, unknown or other
  misc_feature (563)..(563): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttatctgttggtaccgacaggacccaggcactcgtaccccaaatctattctttatgatgtcagtaactccggaccccgtaggggtttctgatcgtcttctagtggctcaagtctgcctacaccggcctcccgtgaccatccgtcccgggctccgacgtcctaggacggacggaggtctgtatttattattgtagttcatactaacaactagtcgtactacgttgggtcgttcgggcggtaggaccgagcgtgaccgtccgtaggtcgacgacccgaggtcctccgcccctcggtcncgtctccgtccccnccctcc

SEQ ID NO: 274245 - DNA, 619 bp, Homo sapiens
  misc_feature: GYAE6OF01CZNB7.27.23.C01.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcgagggcacgagggtcctgggcccagtctgccctgactcgagcctgcctccgtgtcgtgggtcctcgtggacagtcgatcaccatctcctgcactggaaccngatgacgttgncttattaacttntctgtcggtaccgacacggaccagcactcgtacccaatctatttcttangtatgtacagtaacgtcccggaccccgtaggggtttcngtactccgtcttactagtcggcctacgtaagtctcgccgtacgaccgtccctcccgtacgtacctacgtccgtcccgggctccgacgccgtacggacggacgagcgtagtattagttagttagttagttataataactaacaactagtagtaacgtacgttgggtcggtcggtacgggacgggacgacggcgtcgaccgtccgtaaaaaaaacgtcgtacgaccgaacggacgtccgtcccgtaccgtcctactccttccttcccgtccctcccg

SEQ ID NO: 274246 - DNA, 768 bp, Homo sapiens
  misc_feature: GYAE6OF01BZBI0.27.23.C01.1.454.CMB.1.raw
  modified_base (228)..(228): a, c, t, g, unknown or other
  misc_feature (228)..(228): n is a, c, g, or t
  modified_base (336)..(336): a, c, t, g, unknown or other
  misc_feature (336)..(336): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaacccngatgacgttggtgctttataactttatcttgttggtaccgacaggacccaggcactcgtaccccaaactcattcttatgatgtcagtaactcggcccctagggtttcngtatcgtcttctatcggactcaagtctcgcctacgaccggtccctcctcgacctactccgtcccgggccttacccgacgtcccgttaggaacgggaccggaagggtccgtttaggtaaacttttagttttaacgtttacggttttaacggtttacctaaagtttaaccgttaaaccgtaaaacccggtaaggttacggtaaaccgttaaccgggtttttcggggggttacggttttcccggggaccggggtaacggggtaacccggaagggtacccgtacgggtaaccccggttccgttaaaccggggtccgtaaacccgggaccccggtaaaggggtccccgttaccccgggtaccccccccggttcgggttacccctaaccggtttccccgttaccccggtttaccccccgtaacccccgtttcccccgg

SEQ ID NO: 274247 - DNA, 748 bp, Homo sapiens
  misc_feature: GYAE6OF01BXP7H.27.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcagggcacagggtcctgggcccagtctgccctgactcagcctgcctcgtgtctgggtctccgtggacagtcgatcaccatctcctgcactggaaccncgatgacgttggngtcttataactttntctgttgtacacaggacccaggcactcgtaccccaaactcatttctttaatgtatgtcaagttaactccggaccccgtagggtttcaggtactcggtcttcgtacgtcggtctacgtaagtctacgtaccctacgtacccggtcccttaccgtacgtaacctacgttccggtccgggaccttaccgacgtccgtacgggaacgggaccggtaaggtccgttagttaacttttaacgtttaacgtttaggttaacttttaacctaaagttaaccttaaacgtaaacgtacgttaacgaccgttaacgggtttcgggttacgggttccgggaacggggtacggggaacccgtaggggtccttacgggtacccggttaccgttaaacgggtccgtaaaccgggtaccccgaaagggttccccgtacccggttaccccccgttacgggtaaccctacccgttcccgttcccctttacccccgcccctttaacccggg

SEQ ID NO: 274248 - DNA, 578 bp, Homo sapiens
  misc_feature: GYAE6OF01CJP93.27.23.C01.1.454.CMB.1.raw
  modified_base (370)..(370): a, c, t, g, unknown or other
  misc_feature (370)..(370): n is a, c, g, or t
  modified_base (503)..(503): a, c, t, g, unknown or other
  misc_feature (503)..(503): n is a, c, g, or t
  modified_base (555)..(555): a, c, t, g, unknown or other
  misc_feature (555)..(555): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataacttatctgttggtaccgacaggacccaggcactcgtaccccaaactcatttctttatgatgtcagtaactcgggcccctaggggtttctgatcgcttctatggctcaagtctgcctacnccggtcctccctagaccctatccgtccgggcctcccgacgtaccctggacggacgaggactgtatttattattggttattctaattactaacaacctagtagactacgttgggtgttcgggagggacggacgnggctcgaccgtcgtacggtcgacgacccaaggccctacggccccctcggtcncctctccgtcccgtcccgtcccg

SEQ ID NO: 274249 - DNA, 547 bp, Homo sapiens
  misc_feature: GYAE6OF01DWPR8.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactggaaccccncgatgacgttggtgcttataactttatctgttggtaccgacaggacccaggcactgtccccaaactcattctttatgatgtcagtaatcggccccagggtttctgatcgcttctatggctcaagtctgctacacggcctccctgaccatctccgggctccagcctgacgacgaggctagatttattattgtagttcatatacaacctagtgaacgacgtttgggttagttcggacgggtacgggaccgaggctcgaccgtccgtaggtcgacgacccaggactcgcccctcggtcactctcgttcccgccctcccg

SEQ ID NO: 274250 - DNA, 617 bp, Homo sapiens
  misc_feature: GYAE6OF01AQR0I.27.23.C01.1.454.CMB.1.raw
  modified_base (335)..(335): a, c, t, g, unknown or other
  misc_feature (335)..(335): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtccccaaactcattctttatgatgtcagtaatcggccccaggggtttcngatcgcttctatggctccaagtctcgcctacgaccggtccctcccgtcgacctacgtccgtccgggcctccgacgcctaggacggacgaggcttgtaatttagttagtttgttagttacataactaacaacctagtacgacctacgttgggttacggttcgggacgggtaacgggaccgtaggccgtcggacccgttccgtagggtccgacgtacccgaaggtcctcccggtccccccgtcgggtacctaccttccgttcccgttcccccgcccttaccccg

SEQ ID NO: 274251 - DNA, 808 bp, Homo sapiens
  misc_feature: GYAE6OF01EKVN4.27.23.C01.1.454.CMB.1.raw
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (370)..(370): a, c, t, g, unknown or other
  misc_feature (370)..(370): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccnganttggacgttggttgcttttaataacctttatcgtcgtggtaccggaccagggacccaggcacctagtccccaaaacttcctaattctttaatgtatgttacacggtaacctcggggttcccccagggggtttctcggntattacgtcggttacctacctagggtccttccgaacgttacctcggcccttaccctacgggacccccttaccctcgtaccccggacttccctacccggggcccttccgaacgggcccctagggacggtaacggaaggtacttagttagtttaagtttacttagtttaacgttaccaacttaagttaccgaaaccctaacggtttacgggtacttaacccgggtttacggggttacgggggtttaccccggaacgggggtaaccggggtaacccggaaccggggttcccgttaaagggtaaccccccggtttaccggtaccccgggtaaacgggtacccggtacccccggaaacccccgggtcccggttcccggtaccccccccggtttcggtaccccggttaacccccgttacccccgttcccggtttacccccccgg

SEQ ID NO: 274252 - DNA, 692 bp, Homo sapiens
  misc_feature: GYAE6OF01C3MVL.27.23.C01.1.454.CMB.1.raw
  modified_base (246)..(246): a, c, t, g, unknown or other
  misc_feature (246)..(246): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgtttgggtncttaataactttatctgttggtaccgacacggacccaggcactcgtaccccaaactcatttctttatgatgtcaagtaactccggccccgtagggtttctgactcgtcttctatcggctacaagtctgcctacacggtccctcctcgacctacgtccgtccgggtcctacccacgtccgtaggaacgggtaccggaggtctaggtatttaacgttattaggttaacgttacaattacgtaaccaacgtagtacgaaccttacggtttggggtacggttcggggacgggtaacgggacccgtagggaccttacgggtacccggttaccgtaacgggtccgaaaccgggtaccccgaaacgggtcccttaccccgggttacccccccgttacgggttccctaacccgtttcccgttaccccgttccccccgtaaccccgttaccccgg

SEQ ID NO: 274253 - DNA, 660 bp, Homo sapiens
  misc_feature: GYAE6OF01DCU0W.27.23.C01.1.454.CMB.1.raw
  modified_base (341)..(341): a, c, t, g, unknown or other
  misc_feature (341)..(341): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtaccccaaactctattctttatgatgtcaagtaactccggccccgtagggtttcngtactcgtcttctagtcggctccaagtctgcctacgaccggtccctcctcgacctactccgtccgggctcccgagccgtggacggacggaggtcttaggtaatttagttagtttgttaacgtttcaagttaactaaccgaaaccgtagtacgtaaccgtacggtttcgggggtacgtttccggggacggggtacgggtaaccgagggtccgttacggacccgttaccggtaggtccgacggtaccccgaaaggtcccgttacccggcccccgttcgggtaccctaccgttcccgttaccggttccccgtcccttacccg

SEQ ID NO: 274254 - DNA, 643 bp, Homo sapiens
  misc_feature: GYAE6OF01CRY9R.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (337)..(337): a, c, t, g, unknown or other
  misc_feature (337)..(337): n is a, c, g, or t
  modified_base (526)..(526): a, c, t, g, unknown or other
  misc_feature (526)..(526): n is a, c, g, or t
tcagagcgtcgtctcacgaccggtgctcgatttagtacacgtgattagggagttcggggggggtctcaggaggcagcgctctcgggacgtctccaccatggcctggctctgctattcctcaccctctcactcagggcacagggtcctgggcccagtctgccctgactcagcctgcctccgtgtctgggtctcctggacagtcgatcaccatctcctgcacgtggaacccgngatgacgttggncttatactttntctgttgtaccganacggacccaggcactcgtaccccaatctatttctttatgatgtcagtactccggccccgtagggtttcngactcgtcttactatggcctaccgtaagtctacgccttacgaccggtccctcccgtgacctactccgtccgggcctccgcgtccgtggacggacgtacggcttaggtaatttatttacgttgttacgttactatacttaacaactagtcgtaactacggttgggtacgttcgggtacgggacggtacgngggtaccttcggacccgttaccggtaggttccgaccggtacccgaggtcccgtaccccggtcccccggttcgtacccttaccgttccgttacccggttcccccgtccccgttacccg

SEQ ID NO: 274255 - DNA, 724 bp, Homo sapiens
  misc_feature: GYAE6OF01DIZQC.27.23.C01.1.454.CMB.1.raw
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatctcctgcactcggaacccgngatggacgtttggtgtactttaattaacttttntcttggttacggtaccgacgacggacccaggccacgtcgtaccccaaactctatttctttatgtatcgtacaagtaacgtcccggtaccccgtagggtttccnggtactcgtcttntagtcgctacgagttcncgtaccctacgaccggccctcccgtacaacctcgtccgtcccgggcctccgacgtccgtagggaacggacgacggtcttagttaagtttatttagttagttacgttactaagttaacctaacgaaccgtagtacgtaaccgttacgggtttcggggttcgggttaccgggacgggaacgggtaccgtacgggaccttaccggtacccggttccggttaacgggtacccgaaccggtaccccggaacggtcccgtaccccggtccccccggttcgggtaccctacccgtttcccgttacccccgttccccacccggtttaccccg

SEQ ID NO: 274256 - DNA, 576 bp, Homo sapiens
  misc_feature: GYAE6OF01BGTCA.27.23.C01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaacccncgatgacgttggtgctttataacttttatctgttggtaccgacaggacccaggcactgtccccaaactcattctttatgatgtcagtaactcggcccctagggtttctgatcgcttctatcggctcaagtctgcctacacggcctcctgaccatctccgggctccgagcctggacggacgagcctgtacttattatgtagttcagtactacaactagtgactacgttgggtgttcgggacggagggacaggtctcggacccgtcgtaacgggtcacggcccctaagggccttaccgccccccgttcggtccctaccgttcctccggtttccccctacccgttaccccg

SEQ ID NO: 274257 - DNA, 682 bp, Homo sapiens
  misc_feature: GYAE6OF01B4PG6.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacacggacccaggcactcgtaccccaaactcatttctttatgtatgtcagtaacgtccggccccgtagggtttctgactcgtcttactagtcggccttaccaagttcctcgcccgtaccgaccggtcccttccccgtagaccctacgtccgtcccgggtcctccgacgtcccgtaggacgggaccggaggtcttagtaactttaagtttactttaggttaagttacctaataacttaaccaaccgtagtagaacgttacggtttggggtcgggttacgggacgggtacggaccgtacggtccgtacggtacccgttccgtaacggttccgaaccggtacccgaacggtccgtacccgggtccccccgttacggtccctaccgttcccgtttcccgtcccccgtcccttacccg

SEQ ID NO: 274258 - DNA, 664 bp, Homo sapiens
  misc_feature: GYAE6OF01D9NZD.27.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaacccgngatgacgttggtntcttaataactttntcttgttggtaccgacaggacccaggcactcgtaccccaaactctatttctttatgtatgtcaagtactccggccccgtaggggtttctgtatcgcttctagtcggcctacgtaagtcctcgcctacgaccggtccctcccgtacgacctactccgtccgggtcctcccgacgccgtaggacgggacgagggtcctaggtattttaacttagtttgttaagttacaattactaacaaacctaggtcgaacgttacggtttggggtacgttcggggacgggacgggtaccgtagggtccgtacggtacccggtaccgtaacgggtaccgaccggtacccgaacggtccgtcccgacccccgttcggtaccctaccgttcccgttacccggttcccccgtccccttacccg

SEQ ID NO: 274259 - DNA, 700 bp, Homo sapiens
  misc_feature: GYAE6OF01DUXSW.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgtacttataactttatctgttggtaccgacaggacccaggcactcgtaccccaaactcatttctttatgtatgtacagtaactccggccccgtaggggtttctgtatccgtcttctatggcctccaagttcctcgacctaccgaccggtccctccctcgacctactccgtcccgggtctcccgacgtcccgtaggacgggacggacggtcctaggtaatttacgttaagtttaggttaagtttacctaattaactaaccgaaacccgtagttacgtaaccgttacgtttggggtacggtttccggggacgggtacggggtaacccgagggtaccgtaccggtacccggtaccgttagggtaccgtaaccggaccccggtaaggtcccgtacccgggtacccccccttacgggtccctaacccgttccgtttcccggttcccccgtcccccttacccg

SEQ ID NO: 274260 - DNA, 519 bp, Homo sapiens
  misc_feature: GYAE6OF01CZDWK.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (331)..(331): a, c, t, g, unknown or other
  misc_feature (331)..(331): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggngcttataactttatctgttggtacgacaggacccaggcactgtccccaaactcattctttatgatgtcagtaatcggccccagggtttcngatcgcttctatggctccaagtctgcctacacggcctccctgaccatctccgggctcgagctgagacgagctgatattattgtagtcatatacaacagtgacacttgggtgttcggcggagggaccaggctgccgtcctaggtcagcccaaggctcgccccctcggtcactctcgttcccgccctccc

SEQ ID NO: 274261 - DNA, 618 bp, Homo sapiens
  misc_feature: GYAE6OF01BOIVV.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (611)..(611): a, c, t, g, unknown or other
  misc_feature (611)..(611): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttaataactttatctgttggtaccgacgacggacccaggccactcgtaccccaaactcatttctttatcgtatgtacagtaactccggccccgtagggtttctgatcgtcttctatggctcgaagtctcgcctacacggccctccgtgaccctacgtccgtcccgggcctacccgacgtcccgtaggacggacggagggtctaggtaatttaagttagtttaggttacgttactaattaactacaaacctgtacgacctacgtttggggtcgttccgggacgggtacgggaccgaggtccgtggtaacccgtcgtacggtcacgacccgaagggtcctcgcccccgtcggtcacttcctccgtcccnccctccg

SEQ ID NO: 274262 - DNA, 629 bp, Homo sapiens
  misc_feature: GYAE6OF01CFX2H.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactcgtccccaaactcatttctttatgatgtcagtaactcggcccctaggggtttctgatcgcttctatggctcaagtctgcctacaccggccctccctcgaccctactccgtcccgggctcccgagcctggacggacgaggtctagtatttattagttagttagttcattactacaacagttgactacggtttgggtcggttcgggacgggtacgggaccgtagggaccgttacggacccggttaccgtacgggtccgaaccggtaccccgtaacgggtccgttcccggcccccccgttacgggtccctacccgtttccgttcccgtttcccccacccccgttcccg

SEQ ID NO: 274263 - DNA, 625 bp, Homo sapiens
  misc_feature: GYAE6OF01BT1VG.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (335)..(335): a, c, t, g, unknown or other
  misc_feature (335)..(335): n is a, c, g, or t
  modified_base (400)..(400): a, c, t, g, unknown or other
  misc_feature (400)..(400): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggncttataacttatctgttggtaccgacaggacccaggcactcgtacccaaactcattctttatgatgtcagtaactccggcccctagggtttcngtactcgcttctatggctccaagtctgcctacacgtcctccctgacctatccgtccgggctaccncgtcctggacggacgaggtcctagtatttaagttattgttagttacattaactaaccaaccgtagtacgtaaccttacggtttgggtcgtttaccggggacgggtaacgggacccgaggtccgtacggtaacccgtccgttaaggtccgaacggtacccgtaaggtcccgtaccggtccccccttcggtaccaccgtttcctccgttccccgtaccccgtacccg

SEQ ID NO: 274264 - DNA, 689 bp, Homo sapiens
  misc_feature: GYAE6OF01AXCPB.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtaccccaaactcattctttatgatgtcagtaactccggccccgtaggggtttctgtactcgcttctatggctcaagtctgcctacacggtccctccctgacccatccgtcccgggctccgacgtccgtggacgggacggaggtccttaggtaatttaacgttagtttgttaacgtttctaagttaactaaccaaacccgtagttacgtaaccgtacggtttggggttacggtttaccggggaccggggtaacggggacccgagggtccgtacgggtaccccggttccgttaacgggtaccgacgggtaccccggaaacgggtccccgttacccggaccccccccgttcgggttacccacccgtttcccgttaccccggtttccccccgtaacccccgttccccg

SEQ ID NO: 274265 - DNA, 567 bp, Homo sapiens
  misc_feature: GYAE6OF01BTHO7.27.23.C01.1.454.CMB.1.raw
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgcttataactttntctgttggtaccgacaggacccaggcactgtccccaaactcattctttatgatgtcagtaatcggccccctaggggtttctgatcgcttctatggctcaagtctgctacacggcctccctgaccatccgtcgggctccagcctggacggacgaggcttgtaatttacttagtttgttagttctagtactaacaaccagtgactacgttgggtgttcgggacgggagggaccgaggcgtcgaccgtccgtaggtccgacgcccgaaggcctcggcccccttggtccaccgttctccgtccccgtccctcccg

SEQ ID NO: 274266 - DNA, 676 bp, Homo sapiens
  misc_feature: GYAE6OF01AK8BB.27.23.C01.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataactttntctgttggtaccgacacggacccaggcactcgtccccaaactcattctttatgatgtcagtaactccggccccgtaggggtttctgatcgtcttctagtcgctaccaagtctgaccctacgaccggtccctcccgtacgacctactccgtccgggtcctccgacgccgtagacgggaccgacggtctagtactttaacttagtttagttacgttacgtaattaactaactaaacctaggttacgtaacgtaacggtttcgggggttacgttaccggggacgggacggggtaacccgagggtccgtacggtaccccggttccgtaacgggtaccgaacggtaccccgtaaggtacccgttcccggtaccccccgttcgggtacccctaccgttccgttcccggtcccccgtccccgttacccg

SEQ ID NO: 274267 - DNA, 589 bp, Homo sapiens
  misc_feature: GYAE6OF01BPS71.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgctttataacttttatctgttggtaccgacaggacccaggcactgtccccaaactcattctttatgatgtcagtaactccggccccctaggggtttctgatcgcttctatggctccaagtctgccctacacggccctccctgaccactccgtcccgggctccgagccctaggacggacgaggctgtatttattattgtagttcatactacaaccagtcgactacgttgggtgttcgggcggacgggaccagggtcctcggacccgttccgtaggtccgacggtacccgaagggtcctccggccccccgttggtccctacgttccgtccgttcccccgcccttcccg

SEQ ID NO: 274268 - DNA, 737 bp, Homo sapiens
  misc_feature: GYAE6OF01B9Q87.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacgagggtcctgggcccagtctgccctgactcagcctgcctccgtgtctgggtctcctggacagtcgatcaccatctctgcacgtcggaaccgngatgacgttggntcttataactttntctgttcggacganaggaccaggcactcgtccccaatcatttcttangatgtcagtaatccggcccgtagggtttcngatcgtcttctagtcggtctacgagttccgtgcccgtacgaccgtccctcccgcgtaaccncgttccgtcccgggcttacccgacgtccgtacggaacgggtacgaggtcgtaaggtaacttttagttacgtttaggtttacgttactaagttaacttaaacgaaccgttaagttcgtaaaccgttaacgggttttcggggttaccgggttacggggtaccggggtaacgggtacccgtagggcccgttacgggtaaccccgttccggtaaccggggttccgaaaccggtacccccggaaacggggttcccccgttccccgggtacccccccgtttaccgggttaccctaaccccggtttccccgtttcccccgggtttcccccccgtcccccgtttaacccccg

SEQ ID NO: 274269 - DNA, 575 bp, Homo sapiens
  misc_feature: GYAE6OF01AQD6G.27.23.C01.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (384)..(384): a, c, t, g, unknown or other
  misc_feature (384)..(384): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtnctttataactttntctgttggtaccganaggacccaggcactgtaccccaaactctattctttatgatgtcagtaactcggccccctaggggtttctgatcgtcttctatcggctccaagtctgcctacacggccctcccngaccatcctccgggctccacgcctgacggacgaggctagtatttattattgttagttctaagtactacaacagtcgactacgttgggtgttcgggcggaggaccgaggcgtcggtaccgtcgtacggtcgacgacccgaacggcctccggccccccgtcggtccaccttccgtccgttccccgccctcccg

SEQ ID NO: 274270 - DNA, 557 bp, Homo sapiens
  misc_feature: GYAE6OF01EDAUH.27.23.C01.1.454.CMB.1.raw
  modified_base (548)..(548): a, c, t, g, unknown or other
  misc_feature (548)..(548): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataacttttatctgttggtaccgacaggacccaggcactgtccccaaactcattctttatgatgtcagtaatccggcccctagggtttctgatcgcttctatggctcaagtctgcctacacggcctccctgaccatccgtccgggctccagcctgaggacgaggctgatttattattgtagttctatataacaacagtgactacgttgggtcgttcgggacgggacggaccgaggcctcggtaccgtcgtaggtccgacgcccaaggtcctccgcccccgtcggtccactcctcgttccccncccgtcccg

SEQ ID NO: 274271 - DNA, 706 bp, Homo sapiens
  misc_feature: GYAE6OF01EBIS3.27.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (339)..(339): a, c, t, g, unknown or other
  misc_feature (339)..(339): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaacccngatgacgttggtncttataactttatcttgttcggtaccgacaggacccaggcactcgtaccccaaactctattctttatgatgtcagtaactccggcccctagggtttcngactcgcttctagtcggctacaagtctcgtcctacgaccggtccctcctacgacctacgtccgtcccgggcctacccgagtcccgtaggtacgggacggtagggtctaggtaactttacttagtttgttaacgttactaagttaacttaacctaaaccgtaggttacgaaccgttaaccggtttaggggttcgggtttaccggggacggggtaacgggtaacccggtaggtacccgttacggtaacccggttccgtaacgggttacccgaaccggtacccgtaaacgggtcccgttacccgggtccccccgttacgggtaccctacccgttaccgtttccccggttcccccgtccccgttaccccgg

SEQ ID NO: 274272 - DNA, 528 bp, Homo sapiens
  misc_feature: GYAE6OF01DW8SR.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgctttataacttttatctgttggtaccgacaggaccccaggcactcgtaccccaaactcatttctttatgatgtcagtaatcggcccctagggtttctgatcgcttctatggctcaagtctgcctacacggcctcctgaccatcgtccgggctccagcctgacggacgaggctgattattattgtagttcatatacacagtgactacgttgggtgttcggcggaggaccaggctcgaccgtctaggtcacgccaggctcgcccctcgtcactctcgtcccgcctccg

SEQ ID NO: 274273 - DNA, 713 bp, Homo sapiens
  misc_feature: GYAE6OF01CNA0Y.27.23.C01.1.454.CMB.1.raw
  modified_base (250)..(250): a, c, t, g, unknown or other
  misc_feature (250)..(250): n is a, c, g, or t
tcagagcgtcgtctcacgaccggtgctcgatttagtacacgtgattagggagttgggggggggtctcaggaggcagcgctctcgggacgtctccaccatggcctggctctgctattcctcaccctcctcactcagggcacgagggtcctgggcccagtctgccctgactcagcctgcctccgtgtcgtgggtctccgtggacagtcgatcaccatctcctgcacgtcggaacccgcgatggacgttggtntacttaattaacttatcgttggttacggtaccgacgacggacccaggcacgtcgtaccccaactctatttctttatgatgtacaagtaacgtccggtaccccgttagggtttcagtacgttcgtcttacgtacgtcggtacctacgtaacgtcctcgacctacggacccggtccctcccgtacgacctcgtccggtccggtcctaccgacgtccgtaagggacgggaccggtaggtcgttagttaatttagtttagttaggtttacgttaactaattaacctaaccgaacgtaggtctaaacgttacgggttgggttacgggttacgggacggggtaacgaccggtaggtccgttaccggtaccgtacgtacggtaccgaacgtacccggacggtcccgttcccgtccccccgttaggttacccgtaccgttcccgttaccccggtcccccgtcccgtacccg

SEQ ID NO: 274274 - DNA, 674 bp, Homo sapiens
  misc_feature: GYAE6OF01CIM05.27.23.C01.1.454.CMB.1.raw
  modified_base (233)..(233): a, c, t, g, unknown or other
  misc_feature (233)..(233): n is a, c, g, or t
  modified_base (371)..(371): a, c, t, g, unknown or other
  misc_feature (371)..(371): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctcgccctgactcagcctgcctccgtgtcgtgggtctcctggacagtcgatcactatctcctgcacgtggaacccgngatcggtacggttggtcgactttaattaacgtttatcgttggttcggtaccgacgacggacccaggccacctcgtaccccaaactctactttactttatgattgtactacgtaacgtccggtaccccgtagggtttcngtactcgtcttctagtcggctacgtaacgtctacgcctacgaccggtccctcctacgacctactccgtccgggtacctccgtacgcgtacggacggtaccggacgtctagttaatttactttagtttacgtaagttcaattaacctaacaacgtcgtagtaccgtacggttgggttacgggtaccggacgggaccgggaccgacggtccgtacgggtacccgtacgtacggtccgaccggaccgacggtccgtcccgtccccggtcgtctacccgttccgttacccttccccgtccctacccg

SEQ ID NO: 274275 - DNA, 759 bp, Homo sapiens
  misc_feature: GYAE6OF01DJ1HZ.27.23.C01.1.454.CMB.1.raw
  modified_base (316)..(316): a, c, t, g, unknown or other
  misc_feature (316)..(316): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactcggaacccgcgatggacgttggtgactttaattaactttatcttggttcggtaccgacacggacccaggcactcgtaccccaatctatttctttangtatgtactagtaactccggtacccccgtaggggtttctgtactcgtcttcgtaacgtcggtacctaccgtaagtcctacgacccttaaccgacccggtcccttcccgtacggtaaccctacgttcccgtcccgggaccttcccgaacggtcccgtagggaacggaccggtaggtacgttacgtaagttttactttagtttaggttaacgttacctaatttaacgtaaccaaaccgtaggttacggtaaaccgttgggtttacggggttaccgggttccggggacggggtaacggggaacccgtacgggtacccgtaccggtaacccggttcccggttaacgggtaccgtaaaccgggaccccgtaacgggtccccgttacccggccccccgtttacgggtccctaccctttcccgtcccggtttcccccgccccgttacccg

SEQ ID NO: 274276 - DNA, 699 bp, Homo sapiens
  misc_feature: GYAE6OF01AG2TQ.27.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaacccngatgacgttggtntcttataactttntctgttggtaccgacacggacccaggcactcgtaccccaaactctattctttatgtatgtacagtacgtccggaccccgtagggtttctgtactcgtcttactagtcggtcctaccgtaagtcctacgtaccctaccgacccggtccctccccgtacgtaaccctacgttcccggtacccgggcctacccgacgtcccgttagggaacggtaccggtacggtcgttagtaacttttattacgtttagttagttactaattacctaacctaaccgtagttcgtaacttacggtttggggtacgttccgggacggggacgaccggtaggtccgtacggtacccggttaccggtaggttccgaccggtaccccggtaagggtccctacccggtcccccgttacggtccctacccgttccgttcccgttccccccgtcccgttaccccg

SEQ ID NO: 274277 - DNA, 703 bp, Homo sapiens
  misc_feature: GYAE6OF01CLZ7C.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactcggaacccgngatgacgttggncttataactttntctgttggtaccgacaggacccaggcactcgtaccccaaactctatttctttatgatgtacagtaacgtccggcccccgtaggggtttctagtactcgtcttctagtcggtcctaccaagtctcgccctaacgaccggtccctccctacgaccctacgtccgtacccgggcttacccgacggtcccgtagggacggacggacggtccttagtaactttagtttacgttaggttaacgttactaacttaactaacctaaaccgtaagtacggtaactacggtttggggtaccggttacggggacgggacgggtaacccgtagggtccgtacgggtacccgtaccgttacgggtaccgaacggaccccgtaacgggcccgttcccggtccccccgttaccgggttcctacccgttccgttccccggtttcccccgtcccccgtttaccccg

SEQ ID NO: 274278 - DNA, 727 bp, Homo sapiens
  misc_feature: GYAE6OF01BRCDB.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgtcttataactttatctgttcggtaccgacacggacccaggcactcgtaccccaaactctattctttagtgtatgtacagtaacgtccggtccccgtagggtttcaggtactcgtctttctagtcggtacctaccgtaagttcctcgtaccctaaccgacccggtccccttaccccgtacggtaaccctaccgttcccggttcccgggtacccttacccggaccggtcccgttagggaaccgggtacgggtacggtcttaggttaactttaagtttagtttagttacgttactaacttaactaaaccgtaaccgtagtacgaaccgttacgggtttcgggtacgggttaccggggacgggtacgggaccgtacggtcccgtacggtacccgtccggtaacggtaccgaccggtacccgacggtcccgtcccgtcccccgtacggtcctacccgttcccgttaccgttccccccgtcccgtaccg

SEQ ID NO: 274279 - DNA, 625 bp, Homo sapiens
  misc_feature: GYAE6OF01CFUNZ.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggngcttataactttntctgttgtaccgacaggacccaggcactcgtaccccaaactctatttctttatgatgtacagtaactccggccccgtagggtttctgatcgtcttctagtcggctccaagtctcgccctacgaccggtccctcccgtagacctactccgtcccgggtcctccacgcctaggaggacgaggtctagtatttattattgtagttcatataacaactagtgacttacgttgggtcggttcgggcgggagggaccgtaggaccttcggacccggtcgtacggtccgacggtacccgaacgggtcctacccggtccccccgttacgggttaccctacccgttccgttcccggtttccccctaaccccgttccccg

SEQ ID NO: 274280 - DNA, 631 bp, Homo sapiens
  misc_feature: GYAE6OF01CAZ58.27.23.C01.1.454.CMB.1.raw
  modified_base (351)..(351): a, c, t, g, unknown or other
  misc_feature (351)..(351): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgcgatggacgttggtgacttataactttatctgttggtaccgacacggacccaggccactcgtaccccaaactctatttctttatgatgtacagtaacgtccggccccgtagggtttcngtatcgtcttctagtcgctacgtaagtctcgacctacgaccggtccctccctagaccctagtccgtccgggcctaccgacgccgtggaacggacgagtctagtatttattagttgttaagttctaatacgtaacaacgtagtacgtactacggttgggttcggttcgggacggaacgggtaccacggtcgtacggtacccgtccgtaggtccgaacggacccgtaggtcctcccggccccgttcggtcccacgttccgttcccgttccccgcccttaccg

SEQ ID NO: 274281 - DNA, 791 bp, Homo sapiens
  misc_feature: GYAE6OF01C8ORE.27.23.C01.1.454.CMB.1.raw
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctggcccagtctgccctgactcagcctgcctcgtgtctgggtctcctggacagtcgatcacctatctcctgccaccgtcggaaccccgngagtcggtacgtttggtactactttaattaacttttntcgttggttacggtaccgacgacggacccaggcctacgtccgtaccccaaattcttaattttctttatgtattcgtacgtaacgttacggtccccgggtacccgttaggggtttctacgtacgttaccgttcttacgtacggtaccgtcctaaccgtacgttccgtaccgtaccccgtaccggtacccgtccccttaccgtaccgtaaccgtccgttcccgggtacccgggtcctacccgacggtaccggtacggacgggtaacggtcgttacgttaaggtttacttttaatttacggtttagtttaactaactaactttaaccgtaaccgtaaccgtaggtacgtaacggtttcgggttggggttccggtaccggggacgggtacgacggtacggtcgtacccggtaccgttacgtacggacccgaccgtaaccgggaccgttccccggtaccccggttcccccgttacggtaccttaccccgtttacccgtttcccccgtccccgtcccgtaaccgg

SEQ ID NO: 274282 - DNA, 653 bp, Homo sapiens
  misc_feature: GYAE6OF01ELCIX.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgctttaataactttatctgttggtaccgacaggacccaggcactcgtaccccaaactctattctttatgtatgtcagtaactccggccccgtaggggtttctgtatcgtcttctatcggctcgaagtctcgacctacgaccggtccctccctcgaacctacgtccgtccgggcctccgacgtccgtacggacggacggacggtctagtaatttatttagttagttacgttactaattaactaacaaccgttttttagacgtactacggttcgggttcggttacgggacgggtacgggaccgtacggcgtacggtaccgtccgtacggtccgacgtacccgaacggtccgtcccggtcccccgttaccggttcctaccgttccgttcccgttccccgtaccccgttaccccg

SEQ ID NO: 274283 - DNA, 724 bp, Homo sapiens
  misc_feature: GYAE6OF01CPNAM.27.23.C01.1.454.CMB.1.raw
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (344)..(344): a, c, t, g, unknown or other
  misc_feature (344)..(344): n is a, c, g, or t
  modified_base (714)..(714): a, c, t, g, unknown or other
  misc_feature (714)..(714): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcctggacagtcgatcaccatctcctgcacgtcgggaaacccncgaagtcggacggtttggntactttaattaacttttntcttggttacggtaccgacgaacgggacccaggacctacgtacgtacccctaaatctactttacttttagngtatagttacaacggttaacgtcccggtaccccgttaggggtttcacgtacgtccgtacttaccgttagtcggtaccttaacgtaacggtccgtactaccccgttaaccggaccggtccccttaccgtacgaccttacgtcccgtaccgggtcctaccacgtccgtaggacggtaacggtggtacttagtaatttacgttaagttcgttagttactaataactaaactaacgagttacggacctagggttcggttacgggtacgggcggaaggccgacggtacgtacgacccgtacgttacgaccgccggaccgtaacggcccgttacccggtccccgttcggtccttaccgtccgtacccggtttcccncccgttaccg

SEQ ID NO: 274284 - DNA, 844 bp, Homo sapiens
  misc_feature: GYAE6OF01AGS46.27.23.C01.1.454.CMB.1.raw
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtcgtgggtcctcctaggacagtcgatccaccatcctcctgcacgtcggaacccngatgacggttggntcttaatactttgtctggttcgtaccgacacggaccaggcactcgtacccctaaatctaatttcgttatgatcgtacagtaacgtcccggccccgttaaggggtttcctagtacgtacgttcgttacgtacgtccggtactaccgtaagtccctacgtacccgttaaccggacggtcccccttacccggtacaacccgtcggttcccggtacccgggtacctacccgtaacggcccgttaacggaacggggtaccgtaacggttcgtacggttaacgttttacgtttaacggtttacggtttacctttaacgttaacgtttaaccgtaaaccccgttaacgtacggtttaaccgtaaccgtttaaccggggtttacgggggttaccgggttaaccgggggtacccggggtaacggggtaacccgttaaccggggtaccggtttacccggaccccggttttaaccgggaaccggttacccggaacccggtaccccggtaaacggttccccggttaccccggtacccccggtttccgggtaccccttaccgttaaccccggtttccccggtttaccccccgtaccgttaaccccgg

SEQ ID NO: 274285 - DNA, 646 bp, Homo sapiens
  misc_feature: GYAE6OF01B8T4C.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtccccaaactcattctttatgtatgtcagtaactccggcccctaggggtttctgactcgcttctagtcggctcaagtctgcctacaccggccctccctgaccctactccgtccgggctccgagcccgtggacggacgaggtctgtaatttattatttggttagttacaattactaacaaccgtagtacgtaacgtacgtttggggtcgtttcggggacgggtacgggacccagggtccgtacggtacccgttccgtaagggttcccaacgggaccccgaaagggtcccgttacccgggtcccccccttacgggttcccaccgtttcccttacccggtttcccccctaccccgttaccccg

SEQ ID NO: 274286 - DNA, 775 bp, Homo sapiens
  misc_feature: GYAE6OF01C1IUM.27.23.C01.1.454.CMB.1.raw
  modified_base (235)..(235): a, c, t, g, unknown or other
  misc_feature (235)..(235): n is a, c, g, or t
  modified_base (325)..(325): a, c, t, g, unknown or other
  misc_feature (325)..(325): n is a, c, g, or t
tcagagcgtcgtctcacgaccggtgctcgatttagtacacgtgattagggattgggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatcctcctgcactacggaacccgngaatggacgtttggtgtactttaattaactttattctgttacggtaccgacacggacccaggcactcgtaccccaaactcatttctttangatgtcaagtaactccggaccccgtagggtttctgactcgtcttcgtatcggctaccgaagtcctacgacccttaccaccggtccctcccgtacgaccctacttcccgtccgggtcctacccgaacgtcccgtagggaacggacgacggtctaggtaatttacgttagtttacggttacttacctaatttaacgtaacctaaactacggttacgaacgttacggttttcgggggttacggtttccggggaccggggtaggggtaaccgaccgggtacgttaccgggtaaccccggttcgttaacggggttacccaaccgggttaaccccccggaaacgggttccccggttaccccggtcccccccccgggttttacgggtaccccgtttaacccgttacccccgggtttaccccggttttaccccccccgaacccccgttttacccccgg

SEQ ID NO: 274287 - DNA, 743 bp, Homo sapiens
  misc_feature: GYAE6OF01D8OO2.27.23.C01.1.454.CMB.1.raw
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
tcagagcgtcgtctcacgaccggtgctcgatttagtacacgtgattagggagttggggggggtctcaggaggcagcgctctcgggatgtctccaccatggcctgggctctgctattcctcaccctcctcactcagggcacagggtcctgggcccagtctgccctgactcagcctgcctccgtgtctgggtctccgtggacagtcgatcaccatctcctgcactcggaacccgngatgacgttggncttatactttatctgttggtaccgacacggacccaggctactcgtaccccaaatctatttcttatgtatgtacagttaactccggcccccgtaggggtttcctggactcgtctttcgtagtcggtactaccgtaagttcctcgtacccgtacgtacccgggtccccttacccgttcggaacccttacgtcccgtttcccggggccgttacccacggtcccgtagggacggtaaccggaggtccgtagttaatttaagtttagtttacgtttacgttactaacttaactaaccaaccgtaaggttacgtaaccgttaccggttttaggggttaccggttaccggggcgggtaacggggaccgtagggtacccgtaccgggtacccgtaccggttacggtccgtaacccgggacccgtaaaccgggcccgttccccggtacccccgttcccggttaccgtaacccgtttccgttacccccggttccccggttaccccccg

SEQ ID NO: 274288 - DNA, 667 bp, Homo sapiens
  misc_feature: GYAE6OF01CK9VW.27.23.C01.1.454.CMB.1.raw
  modified_base (180)..(180): a, c, t, g, unknown or other
  misc_feature (180)..(180): n is a, c, g, or t
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (302)..(302): a, c, t, g, unknown or other
  misc_feature (302)..(302): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctcgtntctggtctcctggacagtcatcacntctctgcacgtggaccngatgacgttggnacttatacttntctgtagtaccacgaggtaccaggctacgtcgtaccccaaatcgtaatttctttagngtacgttcgtactaacgttacgtcccgggtaccccgttaggggtttcaggtactcgtacttacgtagtcgactacgtaacgtctacgtcctaacgccgtaccctccgtacaccgtcgtaccgtcggactaccgacgtccgtaggacgacgtacgtcgttagtaatttcgttacgttacggtacgttactaactaacgtaactacgtagttacgacgttacgggtttcggtacggtacggacgggtacggtaccgacggtccgttacggacccggttacgtaggtaccgaaccggtacgtaaccgggtccctacccggtacccgtcgtacctaccgttaccgttccccgtcccgtaccgttacccg

SEQ ID NO: 274289 - DNA, 627 bp, Homo sapiens
  misc_feature: GYAE6OF01C3770.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggnctttataactttatctgttggtaccgacaggaccaggccactgtccccaaatcattcttatgatgtcagtaatccggccccagggtttctgtatcgtcttactgtcggctaccaagtctcgcccttaacgaccggcccttaccctgacccattcccgtacccgggtctcccgacgtccctaggacgggtacgacggccttaggtaatttagttacgttaggttaattcgtaagttactaacgaactaggtacgaactaccgtttgggtacgttcgggcgggtacggaccgaggcctaggacccgtcgtaaggccgtaacggacccgtaaggcccttacggcccccttcgggtccaccgttccttccggttcccccgtccttacccg

SEQ ID NO: 274290 - DNA, 598 bp, Homo sapiens
  misc_feature: GYAE6OF01EMFME.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (372)..(372): a, c, t, g, unknown or other
  misc_feature (372)..(372): n is a, c, g, or t
tcagagcgtcgtctcacgaccggtgctcgatttagtacacgtgattagggattggggggggtctcaggaggcagtgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggngcttataactttatctgttggtaccgacaggacccaggcactcgtaccccaaactctatttctttatgatgtcagtaactccggccccgtagggtttctgatcgtcttctagtgctcaagtctgcctacncgtcctcctgaccatccgtccgggctccacgtcctaggacggacgaggctagtatttattagtttgtacgttactattaataccaaccgtagtagtaactagttgggtggttcgggacgggaggtaccgaggtcgtcggacccggttccgtaacggtccgacggacccgaacggtcctccggtcccccgttcggtccctacgttccgtccgttccccgccctcccg

SEQ ID NO: 274291 - DNA, 727 bp, Homo sapiens
  misc_feature: GYAE6OF01DQCPE.27.23.C01.1.454.CMB.1.raw
  modified_base (369)..(369): a, c, t, g, unknown or other
  misc_feature (369)..(369): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctctgcactcggaacccgcgatgacgttggtgtactttaataacttttatctggttcggtaccgacgacggacccgaggcctactcgtaccccaaactctatttctttatgtatgtacagtaacgtccggaccccgtagggtttctgactcgtcttntagtcgcctacgtaagtctcgccctaacgaccggtccctacccgtgaacctacgtcccgtcccgggtaccttccgacgtcccgtgggaacggtaccggtacggtcttaggaactttttaacgttagttttacggttaacgtttaccaacgtttaaacgtaaccctaaaccgttagtacggtacgttaacgggtttcggggttcggttaccggggaccgggtaacgggacccggtaggtccggttaccggtacccggttaccggttaacggccgaaccggtacccgaacggtcccgttaccccgtcccccggttcggtacctacccttccggttacccgttcccccgacccgttccccg

SEQ ID NO: 274292 - DNA, 610 bp, Homo sapiens
  misc_feature: GYAE6OF01BRIGG.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggncttataactttntctgttggtaccgacacggacccaggcactcgtaccccaaactctattctttatgatgtcagtaactcggccccgtagggtttctgtactcgtcttctagtcggtctccaagtctcgcctacaccggtccctcctcgacctactccgtccgggtcctccgacgtccgtggacggacgaggtctagtattattattgtacgttcaattactactaaccgtagtacgtactacggttgggtacgttcgggacggacggtacgacggcgtacggaccgttccgtaggtccacggtacccaaggtcctaccggtcccccgtcggtacctaccgttcctcccggttcccgcccttacccg

SEQ ID NO: 274293 - DNA, 793 bp, Homo sapiens
  misc_feature: GYAE6OF01BN9I4.27.23.C01.1.454.CMB.1.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctctgcactggaacccgngatgacgttggtnactttataactttatcttgttggtaccgacacggacccaggcactcgtaccccaaactctactttctttatgtatcgtacgaagtaacgtccggtacccccgtaggggtttctaggtacgttccgtactttacgtacgttcggtccttaccgtaacgttcctcgtacccctaccgtaccggtcccctcccgtacgacccgtacttcccggtcccgggtacctaccccgtacggtcccgtagggaacgggtaacggtacgggtacttaacggttaacttttaacggtttaacgtttacggtttaacgtttaccttaaattaaccttaaccgaaaccgttacggtaacggttaccgttaacgggttttcggggtacgggttaccggggacgggggtaacgggacccgtagggtaccgtaccgggtaacccggttccggtaacgggtccgtaacccgggtaccctaaccgggtcccgttccccgggtaccccccgttacgggttaccctaccccgtttacccgttaccccgttaccccccgtcccccgttaacccg

SEQ ID NO: 274294 - DNA, 708 bp, Homo sapiens
  misc_feature: GYAE6OF01DEELF.27.23.C01.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctgccctgactcagcctgcctcgtgtctggttctcctggacngtcgatcacatctcctgacacgtcggaaccngatgacgttggntcttattaactttntcgtgttacggtaccgacgacggaccaggctactcgtacccaaattctattntttacngtatcgtacaacgtaacgtcccggtacccgtaggggttttcngtactcgtctttacgtagtcggacctacgtaacgtctacgtcccgtaacgtcccggtccttaccgtcgaacctcgttccggttacccggttacacggtccgtaggaacggacgtacggtcttaggtaatttactttagttacgttaagttactaattactaaaccgtaccgtaagtacgtaacgttcgggtttgggttcggtaccggggtacggtaaccgggtacggtacggaccggttcgggtaacccgttcggtaccgggtccgtaccggaacccgtagggtcccgtcccggtcccccgttacggtccttacccgttcgttaccccggtccccgtccgtccctacccgg

SEQ ID NO: 274295 - DNA, 793 bp, Homo sapiens
  misc_feature: GYAE6OF01BQJUZ.27.23.C01.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctcgtgtctggtctctggacngtcgatcaccatctctgcacgtcggaacccgngatggacgttggtgtctttaattaactttatcttgttacggtaccgacacggacccaggcactcgtaccccaaactctatttctttatgtatcgtctaagtacgtccggaccccgttagggtttctagtactcgtacttctagtcggtactcctaaagtccgtcgtaccctacgacccggtccccttacccgtacgaccctacgttcccgtcccgggtactacccgtacggtcccgtagggaccggtacgtacggtcgtaggttaattttagttagtttcggttaacgttacttaacttaactaacccgtaacgtaacggtacgtaaccgttacgggtttacggggttaccggtttcgggggaaccggggtacgggtaacccggtacggggtacccgttaccggtaaccccgggtttaccggttaccgggtaacccgtacccgggaaaccccggtacggggttcccccgttaccccgggtcccccccccgggttacgggtttacccctaacccccggttttccgtccccccgggtttcccccccgtcccccgtttaacccccgg

SEQ ID NO: 274296 - DNA, 605 bp, Homo sapiens
  misc_feature: GYAE6OF01EOGY0.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttntctgttggtaccgacaggacccaggcactgtccccaaactctattctttatgtatgtcagtaactcggcccctagggtttctgatcgcttctatggctcaagtctgcctacaccggcctccctgaccactcgtccgggctccagcctggacggacgaggtctagtatttattagttgttagttacagttactactaaccagtcgactagttgggtgttcgggcggagggacccgagggtcctacggacccgttccgtacgggtaccgaacggacccgaacgggtccctaccggccccccgttacgggtccctaaccgttcccgttccgttccccccgtcccgttaccccg

SEQ ID NO: 274297 - DNA, 724 bp, Homo sapiens
  misc_feature: GYAE6OF01DEC3X.27.23.C01.1.454.CMB.1.raw
  modified_base (354)..(354): a, c, t, g, unknown or other
  misc_feature (354)..(354): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccccgcgatgacgtttgggtgtcttaattaactttatctgttggtaccgacgacggacccaggcactcgtaccccaaactctactttactttatgtatgtcaagtactccggtccccgtagggtttcngtactcgtcttctagtcggaccttaccgaagtccgtcgtccctaccgacccggtccctcccgtacgaccctacgtcccgtacccggggtcctacccaacggtcccgttagggaacgggtaaccgggagggtccttaggttaaacttttagttttaacgtttaggttaacggtttactaacgttaactaaccaaaccgtgtacgtaacgttacggtttggggttcgttaccggggcggggtaacggaaccgcggtaccgtaccggtacccggtaccgtacgggtaccgaaccggtacccgaacggtcccgtcccgccccccgttcggtacccttacgttcccttaccccgttcccccgtccccgttacccg

SEQ ID NO: 274298 - DNA, 628 bp, Homo sapiens
  misc_feature: GYAE6OF01EDWSZ.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtncttataactttatctgttggtaccgacacggacccaggcactcgtaccccaaactctattctttatgatgtcagtaacgtccggcccccgtaggggtttctgtactcgtcttctagtcggcctaccaagtctgccctaccaccggtccctccctgacctactccgtcccgggcctccacgtcccgtggacggacggaggtctaggtatttaattatttggttaattctaattactaacaacctagtacgactacgttggggttgttacgggcgggaacgggaccgaggtccgtcggtaccgtccgtagggtccgaacggtcccgaaggtccgtccggtcccccgtacgggtcctaccgttcccttccgttcccccgcccgtcccg

SEQ ID NO: 274299 - DNA, 785 bp, Homo sapiens
  misc_feature: GYAE6OF01A1DB8.27.23.C01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctctgcactcggaacccgngatgacgttggtntcttataactttntcttgttcggtaccgacacggacccaggcactcgtacccctaaactctactttctttatgtatgtcagtaacgtccggtaccccgtaggggtttctacgtacgtcgtcttcgtacgtcggtcctaccgtaagtccgtacgtaccctaaccggtaccggtccccttcccgtacgtaacccctacgtcccggtcccggggtacctcccgacggtcccgtagggaccgggacggtacgggtacgttacggttaattttaacgtttagtttacggttaacgttacctaaacttaacgttaaccctaaaccgtaaggttacgtaaccgttacgggtttacggggttccgggtttacggggaccggggacgggtacccggtacgggtacccgttaccgggtaaccccgttccggtaacgggttacccgaaccggtacccggaaacgggtccccgttacccgggtcccccccggttacgggtacccctacccgtttcccggtttccccggtttccccccgtccccgttaccccg

SEQ ID NO: 274300 - DNA, 689 bp, Homo sapiens
  misc_feature: GYAE6OF01AZ2YK.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaacccgngatggacgtttggtgctttataacttttatctgttggtaccgacaggacccaggcactcgtccccaaactcatttctttatgtatgtcagtaatccggccccctagggtttctgatcgcttctatggctccaagtctgcctacaccggccctccctgacccattcccgcccgggtcctcccgacgtcccgtaggacggacgacggtactggtaactttagtttacttggttaagttccgtaattaacttaaaccgaacccgtaggtacgtaacgtaccggtttaggggttacggttccggggaccgggtaacgggtaacccgacgggtccgttacggtacccggttaccgtaacgggttccgaacggacccccgtaacgggtcccgttacccggtaccccccgttaccgggtaccctaccgttccccgttccggttcccccccgtcccgttacccccg

SEQ ID NO: 274301 - DNA, 675 bp, Homo sapiens
  misc_feature: GYAE6OF01A9ASX.27.23.C01.1.454.CMB.1.raw
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
tcagagcgtcgtctcacgaccggtgctcgatttagtacacgtgattagggagttggggggggtctcgaggaggcagtcgctctcgggacgtcgtaccgaccatggcctggctctgctattcctcaccctcctcactcgagggcacagggtcctgggcccagtctgccctgactcagcctgcctccgtgtctgggtctcctggacagtcgatcaccatctcctgcacgtggaacccgngatgacgttggtnctttataactttatctgttggtaccgacaggacccaggcactcgtaccccaactcattctttatgatgtacagtaactccggcccctaggggtttctgatcgtcttctatggctccagtctgcctacgaccggtcctcccgtgacctactccgtccgggcctcccgacggtccctgggaacgggacgggaacggtcgttacggtaattttatttaagtttgttaacgtttcctaaatactaacgtaaaccctaggttacgtaacgtaccggtttggggttccggttttcggggaccggggtacggggtacccgagggtccgtcggtaaccccggttcgttaacgggtccacggccccgaaagggccctaccggtccccccttcgggtcctacccgttccgtcccgttcccccgtcccttaccccg

SEQ ID NO: 274302 - DNA, 821 bp, Homo sapiens
  misc_feature: GYAE6OF01A6S0T.27.23.C01.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (351)..(351): a, c, t, g, unknown or other
  misc_feature (351)..(351): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacntctctgcactggaacccgngatgacgttggtgctttaataactttntcttgttcggtaccgacgacggacccaggccactcgtaccccaatctatttctttatgatgtacgtagtaacgtccggtaccccgtaggggtttcngtactcgtcttctagtcgcctacgtaagtctcgtacctacgccggtccctccgtacgaccctacgttccgtcccggtcctaccgacgtcccgtagggacgggaaccggtacggtaccgttaggttaaacttttaagttttacggttttacggtttaacgtttactaaacgtttaaccgttaaacccgtaaacccgtagggttaaccgtaaccgtttaccgggttttacgggggttacgggtttaccgggggaaccggggttaaccgggtaacccgggtaaggggttaccccggttaaccgggtacccccgggttaaccgggttaaacccggggttaccggaaacccgggttacccccggtaaacggggttcccccgttcccccggtacccccccggggttttccggtaaccccttacccgttacccccggttttaccccgtttaccccccccgtacccctttaccccggg

SEQ ID NO: 274303 - DNA, 606 bp, Homo sapiens
  misc_feature: GYAE6OF01BVDH0.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaacccgngatgacgttggtgactttataactttatctgttggtaccgacacggacccaggcactcgtaccccaaactctattctttatgatgtacagtaacgtccggaccccgtagggtttctgtactcgtcttcctagtcggcctcgtaagtctcgccctacgaccggtccctcccgtagacctacgtccgtccgggcctaccgacgccgtggacggacggagtctagtaatttattagttgtatctaatactaactaacagtacgaactcggttggtcggtacggcggaggacgacggtcgtacgtaccgtcgtaaggtccgacggacccgaaggtcctccggcccccttggtcctaccgtcctccgttccccgcccgtccg

SEQ ID NO: 274304 - DNA, 850 bp, Homo sapiens
  misc_feature: GYAE6OF01D7EYF.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtncttataactttatcttgttggtaccgacacggacccaggcactcgtaccccaaactctatttctttatgtattgtacagtaacgtcccgggtcccccgtaggggtttctagtacgttccgtcttactagtcggtcctacctaagtcctcgtaccctaaccgaccggtccctaccccgtacgtaacccctacgttcccgtcccggggtccttacccgacggtcccgtagggaacgggaaccggtacgggtccttaggttaacttttaacgtttaacgttttacggtttaacggttttaacctaaactttaaaccgttaaacccgtaaacccgtaaggtttaaccggtaaacccgtttaaccggggtttttcggggggttaccggggtttaccgggggaccggggggttaaacggggaccccggtacggggtacccgttaccgggtacccccggttacccggttaaccggggtacccgaaccgggtaaccccccgtaaacggggtcccccgttacccccgggaccccccccggtttaccggggttacccccgtaacccgtttaccccggtttcccccggtttaaccccccctccccccgtttaaccccgg

SEQ ID NO: 274305 - DNA, 822 bp, Homo sapiens
  misc_feature: GYAE6OF01CARHM.27.23.C01.1.454.CMB.1.raw
  modified_base (226)..(226): a, c, t, g, unknown or other
  misc_feature (226)..(226): n is a, c, g, or t
  modified_base (354)..(354): a, c, t, g, unknown or other
  misc_feature (354)..(354): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcatcaccatcctctgcacgtggaacccngatgtacgttggtcgtcttaataactttatctgttcggtaccgacacggaccaggcactcgtaccccaaatcatttcttatgtatgtacagtaacgtccggccccgtagggtttctgtactcgtcttntacgtcgtacctacctagttcctacgtacccgtaacgacccggtcccttcccgtacgtaaccctacgttcccggtcccgggtcctacccgtaacggtccgtacgggaacgggtaccggggtaaggtccgttaaggttaaacgttttaacgttttaacgtttaacgggttttaacgtttaacccgtaaacgtttaaacctaaacccgtaaaacccggtaagggttaaccgtaaaccgtttaccgggttttacgggggttccgggttacccgggggtacggggaaccggggtaacccggtacgggttacccggtaccgggttaaccccggttaccggttaaccgggtacccgtaaccgggtacccccgtaacggggtccccgttaacccccggtcccccccggttaccgggtacccgttaccccgtttacccgggttcccccgtttacccccccggtcccccttacccgg

SEQ ID NO: 274306 - DNA, 692 bp, Homo sapiens
  misc_feature: GYAE6OF01BPYGS.27.23.C01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtacacgtgattagggattggggggggtctcaggaggcagcgctctcggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgtcttataactttatctgttggtaccgacaggacccaggcactcgtccccaaactcattctttatgatgtcagtaactcggcccctagggtttctgatcgcttctatggctccaagtctgctacacggcctcctgacctatccgtccgggtctccagcctggtacggacgacggtctagtatttaactttagtttgttaacggttactaattaacgtacctaaaccgtagttacggtaaccgttaccggttttacgggggtcggttttaccggggacggggtaacggggtaacccgaacgggtccgttacgggaaccccggtttccggttaaccgggtaccggtaaccggacccccgtaaacgggtcccgttaccccgggtacccccccgttcgggttacccttaacccgtttcccgtttcccggtttcccccgtacccccgtttcccccgg

SEQ ID NO: 274307 - DNA, 646 bp, Homo sapiens
  misc_feature: GYAE6OF01ENB5G.27.23.C01.1.454.CMB.1.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgtanttggtaggtgtatactttaattacttntgttcgtacgacgaccacggcgacgnccgtacctacccaatctttattcgttatgtctacgttaacgcttaacgtcccggacccccgttaggggttttcctagaaccgtcgttcttactaggtccgtcctaacgtacgtcgtccgtacctaccggacccgtcccctccgacgacctactccggtcccgtccaccgtaccgtcgtagggacggacggtacgtcgtagttaattacttgttagttactactaatactaaccaacgtagtacgtaacgttgggttgggttcggtccgggacgggaccggacgacgtcgaccgtccgtacggtcgcaccgacgacgtccgccccgtcccgtcgtactcctcgttcccgtcccctcccg

SEQ ID NO: 274308 - DNA, 723 bp, Homo sapiens
  misc_feature: GYAE6OF01EAIG9.27.23.C01.1.454.CMB.1.raw
  modified_base (233)..(233): a, c, t, g, unknown or other
  misc_feature (233)..(233): n is a, c, g, or t
  modified_base (319)..(319): a, c, t, g, unknown or other
  misc_feature (319)..(319): n is a, c, g, or t
tcagagcgtcgtctcacgaccggtgctcgatttagtacacgtgattagggattgggggggggtctcaggaggcagcgctctcgggacgtctccaccatggcctgggctctgctattcctccaccctcctcactcagggcacagggtcctgggcccagtctgccctgactcagcctgcctccgtgtctgggtctcctggacagtcgatcaccatctcctgcacgtggaacccgngatgacgttggtgtactttataactttatcttgttacggtaccgacacggacccaggcactcgtaccccaaactctatttctttangtatgtacgaagtaacgtccggaccccgtaggggtttctagactcgtcttctagtcggcctaccaagttcctacgtaccctaaccgaccggtccccttcccctaggaaccctacgttcccgtcccgggtccttacccgacgtcccgtaggacgggtaaccgacggtctagtaatttactttagttacgttagttctaataactaacgaaccgtagtacgtaacttacgggtttcgggttacggttccgggacggggtaacgggaccggtacgggtccgtacgtaacccggttccgttaacgggtccgaacccggacccgtaacgggtccctccccgggtccccccgttaacgggtcccttaacccgttcccgtttcccggttaacccccctccccgttaacccg

SEQ ID NO: 274309 - DNA, 674 bp, Homo sapiens
  misc_feature: GYAE6OF01BM4W8.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccngatggacgttggntcttaataactttntctgttcggtaccgacacggacccaggcactcgtaccccaaatctatttctttatgtatgtcaagtaacgtccggaccccgtaggggtttctgtatcgtcttctagtcgcctcaagtctcgtacctacgaccggtccctcccgtacgaccctacgtccgtaccgggccttaccgacgtcccgtaggacgggacgacggtcttacgtaattttagttagtttcgtaagttacctaagttaacctaaccgtaacctaggtacgtaacgttaacggtttggggtacgtttccggggacgggtaacggaccgacgggtcctaccggtaccgttccggtacgggcgtaccggacccgtaaggtcccgtcccgtcccccgttcgtaccctacgttacccgtcccgttcccccacccgttcccg

SEQ ID NO: 274310 - DNA, 642 bp, Homo sapiens
  misc_feature: GYAE6OF01C887F.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactcggaacccgngatgacgttggtgtacttataacttatcgtgttggtaccgacacggaccaggcactcgtaccccaaactctatttctttaatgtatgtacaacgtaacgtccggccccgtagggtttctgactcgtctttctagtcggtcctacgtaagttctacgtaccctaccgtacccggtcccttacccgtacgaccctacgtcccgtcccgggtcctccgacgcctagggacggacggtaggtctagtaatttagttattgttaagttacaattactaacaacgtgtacgtaacgtacggttgggttcgggtcgggacgggacgggtaccgaggtcgtcgtaccgtccgtaggccgtacgaccgaacggtcctccggcccccgtcggtccctacgttcctcccgtccctccccgtccg

SEQ ID NO: 274311 - DNA, 789 bp, Homo sapiens
  misc_feature: GYAE6OF01DCK1B.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtcggaacccgngatggacgtttggtgactttaattaacttttatcgttggtttacggtaaccgacgacggacccaggccactcgtaccccaaatctatttctttatgatgtacaagtaacgtcccggtaccccggttaggggtttcctagtacgtccgtcttactagtcggtaccttaccgtaagtcctcgtacccgtaccgaccggtcccttacccgtcgaaccctacgttcccggtacccgggtcctacccgtacgtccgtacggacgggtaacgtacggtccttaggttaatttaagttacgtttaggttacgtttacctaagttaacctaaacccgtaaaccgtaggttacgtaaccgttaacgggttttcggggttacgggtttaccggggaacggggtaaccgggtaacccgtagggtacccgttaccggtacccggttacccggtaacgggtacccgaacccggtacccggtaacggtccccgttaccccgggtccccccgttacgggtacccctaaccgtttcccggttacccgttccccccgtcccgttaaccccgg

SEQ ID NO: 274312 - DNA, 677 bp, Homo sapiens
  misc_feature: GYAE6OF01DGT27.27.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (350)..(350): a, c, t, g, unknown or other
  misc_feature (350)..(350): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctcgtgtctgggtctctggacagtcgatcaccatctcctgcacgtcggaacccngatgacgttggtncttataactttntctgttcggtaccgacgacggaccctaggcctactccgtaccccaaatcctatttctttaatgatgtcaagtacgtccggaccccgtaggggtttcnggtactcgtctttcacttcggcctacctaaggtcctcgtacctaccgaccggtccctcctcgacctactcccgtccgggctccgacgtccgtagacggacgtacggtctacgtatttaattagttacgtttaaggttactaatttaactaaccgtaaaccgtagttacgtaaccgttacggtttcggggttacggttcggggtacggacgggacgtacggtaccgttaccggtaccgtaccgtacggtaccgacgtacccgtaacggtccctacccggcccccgttcggtacctaccgttccttacccggtccctccccgttacccg

SEQ ID NO: 274313 - DNA, 655 bp, Homo sapiens
  misc_feature: GYAE6OF01AQLW4.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
  modified_base (345)..(345): a, c, t, g, unknown or other
  misc_feature (345)..(345): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngtcttataactttntctgttcggtaccgacaggacccaggcactcgaccccaaatctatttctttancgatcgtcaagtaactcccggccccgtagggtttcngtactcgtcttctagtcggtcctacgtaagtcctacgtaccctaaccgaccggtccctcccgtacgaccctacgtcccgtcccgggacctcccgacgtccgtaggacggtacgacggtctagtatttattagttacgttagttctaattacgtaccgaacgtagtacgtacgttacggttgggtacgtacgggcggacgggtaccgaggccgtacggacccgttcgtaggtaccgtaccggacccgtaaggtccctcccggcccccttacggtccctacccgttccgtcccgttccccgcccgttacccg

SEQ ID NO: 274314 - DNA, 676 bp, Homo sapiens
  misc_feature: GYAE6OF01CCKKC.27.23.C01.1.454.CMB.1.raw
  modified_base (232)..(232): a, c, t, g, unknown or other
  misc_feature (232)..(232): n is a, c, g, or t
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
  modified_base (663)..(663): a, c, t, g, unknown or other
  misc_feature (663)..(663): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgngaatggacgttggtgctttaataactttntcttgttggtaccgacaggaccaggcactgtaccccaaatcattctttangatgtcagtaatccggccccgtagggtttcngtactcgtcttctagtcggtcctaccgtaagtctcggaccctacgaccggtccctccctcggaaccctacgtccgtcccgggcctaccgacgtcccgtaggacggacggtacggtccttagtaacttttagttacttaggttacgttcaattaacctaacgaactaggttcgtaactacggtttgggttacgttaccggggacggtacgggtaccgaggtacgtacggtacccgtcgtaacggccgtaacggacccgtaaggtcccgtacccggtccccccgttacgggttacccaccgttcccgttaccggttccccccnccccgtttacccg

SEQ ID NO: 274315 - DNA, 650 bp, Homo sapiens
  misc_feature: GYAE6OF01C3AKF.27.23.C01.1.454.CMB.1.raw
  modified_base (245)..(245): a, c, t, g, unknown or other
  misc_feature (245)..(245): n is a, c, g, or t
  modified_base (316)..(316): a, c, t, g, unknown or other
  misc_feature (316)..(316): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaacccgcgatggacgttggngacttataactttatcttgttcggtaccgacacggacccaggccactcgtaccccaaactcatttctttangtatgtcaagtaactccggccccgtaggggtttctgactccgtcttctagtggtcctacaagtctcgcctacgaccggccctccctgaccctatcccgtccgggctccgagcccgtaggacggacggaggtctaggtaatttactttatttgttaacgtttcaattaactaacaaccgtagtcgtaactacgtttcggggtaggttcgggacgggtacgggaccgacggtcgtacggtaccggtaccgtacggtaccgacggacccgaacggtccgttacccgcccccgttacggtccctaccttccgttcccggttccccgtcccttaccccg

SEQ ID NO: 274316 - DNA, 652 bp, Homo sapiens
  misc_feature: GYAE6OF01DPY3H.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (336)..(336): a, c, t, g, unknown or other
  misc_feature (336)..(336): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatcctcctgcactcggaacccngatgacgttggtncttaatactttatctgttcgtaccgacacggacccaggcactcgtacccaactctattctttatgatgtcagtactcggcccctagggtttcngactcgcttcgtatcggcctcaagtctcgcctaccgccgtccctcctacgacctacttccgtccgggtcctaccgacgtccgtaggacggtacgaggtctagtatttacttatcgttatacgtatacaactaaccgtagtacgtaaccgtcgtttggggttcgttcgggaccggggtaacgaccgtcggtaccgtaccggtacccgtaccgttacgggtcccgaaccggacccggtaacgggccccgttcccgggtaccccccttcgggtaccctaacgtttcccgtttcccggtaccccccttacccgtaccccg

SEQ ID NO: 274317 - DNA, 785 bp, Homo sapiens
  misc_feature: GYAE6OF01CM2UD.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (353)..(353): a, c, t, g, unknown or other
  misc_feature (353)..(353): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatgacgttggtncttataacttntctgttcggtaccgacgacggacccaggccactcgtaccccaaatctatttctttatgtatcgtacagtaacgtccggacccccgtaggggttttccngtactcgtcctttactacgtcggtacctaccgtaagttccgtcgtaccctaaccgacccggtccccttcccgtacgtaaccctacgttcccggtcccgggtcctacccgacggtcccgtacggaacgggaccggtacggtcgttaggtaattttagttagtttacggttaacgtttacctaattaacgtaaccgtaaaccgtaggttacgtaaccgttacgggttttggggttacgggtttccggggaccggggtaacggggtaacccggtagggtacccgtaccgggtaccccggttacccggtaacgggtacccgaaccgggtacccccgtaaacggggtccccgttaccccgggtacccccccggttacgggttacccttaccccgttcccggtttaccccgggttccccccgtcccccgttaccccgg

SEQ ID NO: 274318 - DNA, 705 bp, Homo sapiens
  misc_feature: GYAE6OF01DOIKH.27.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaacccngatgacgttggtncttataactttntctgttgtaccganacggacccnggcactcgtccccaaactctatttctttancgtatgtacagtaacgtcccggccccgtaggggttttcaggtatcggtctttctacgtggccttacctaagtctacgtccctacgaccggtccctccctacgaaccctacttccgtccgggtacctcccgaacgtcccgtaggacgggacggtaacggtctacggttaatttagtttagtttacggtttaagtttccaaatttaactaaaccaaaccgtagttacgtaaccgtaacgttttggggttacggttccgggacggggtaaccgggaaccggtagggccgttaccggtaccgtcccggttaagtccggtaaccgcccggaaacggtcccgtaccgtaccccccgtaccgggttccttaccgttcccgttcccggtttccccgcccgttccccg

SEQ ID NO: 274319 - DNA, 763 bp, Homo sapiens
  misc_feature: GYAE6OF01DA35P.27.23.C01.1.454.CMB.1.raw
  modified_base (241)..(241): a, c, t, g, unknown or other
  misc_feature (241)..(241): n is a, c, g, or t
  modified_base (266)..(266): a, c, t, g, unknown or other
  misc_feature (266)..(266): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctggcccagtctgccctgactcagcctgcctccgtgtctgggtctcctggacagtcgatcaccatctcctgcactggaacccgcgatgacgttggtncttatactttatctgtggtaccganacggacccaggcactcgtaccccaaactcatttctttatgatgtcagtaactccggccccgtaggggtttctgactcgtcttctatcggctaccgtaagtctacgcctacgaccggtccctcccgtcgaccctacttaccgtcccgggtcctacccgacggtaccctagggtacgggaccgggacggtaccgttaggttaaacttttacgtttaagttttcggtttaacggtttacctaacgttaaactttaaaccccgtaaaccgtaacgggtttacgtaacccgtttaccgggttttagggggtttacgggtttccgggggaccggggtaacgggggtaaccccgagggttaccgttaccggggtaaccccggttccgttaacggtacccgtacccgggtaccccgtaacgggtccccgttccccggtaccccccgttacgggtccccttaaccttcccgtttacccccgttcccccgtacccccgttacccccg

SEQ ID NO: 274320 - DNA, 724 bp, Homo sapiens
  misc_feature: GYAE6OF01A280M.27.23.C01.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (340)..(340): a, c, t, g, unknown or other
  misc_feature (340)..(340): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtggaacccgngatgacgtttggtgcttataactttntctgttggtaccgacaggacccaggcactcgtaccccaaactcattctttatgatgtcagtaactcggtccccgtagggtttcngtactcgtcttctatggctccaagtctgccctacgacggtccctccctacgaccctacgtccgtcccgggtacctcccgaacgtccgttaggacgggtaccgtacggtcttaggttattttaacgttagtttacggttaacgtttaccgtaatttaacgtaacctaaaccgtaggttacgtaaccgtacgggttttacggggttacggtttccggggacggggtaacgggtacccgtaggtccgttacgggtaacccggttcccgttaacgggtaccgaccgggtaaccccggaacgggtccccttacccgggtacccccccgtttacgggttacccgtacccgtttaccgtcccggtttaccccccgtcccccgttaccccgg

SEQ ID NO: 274321 - DNA, 715 bp, Homo sapiens
  misc_feature: GYAE6OF01DGU43.27.23.C01.1.454.CMB.1.raw
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctgccctgactcagcctgcctccgtgtctggtctcctggacagtcgatcaccatcctcctgcacgtcggaacccgcgatggacgtttggtgtctttaattaacgttttatcgttaggtttcggtaaccgacgacggacccgaggcctacgtacgtacccctaaactctactttctttatgtatcgtacaagttaacgtcccggccccgtaggggtttcctagtactcgtcttcgttatcggtcctacgtagtcctcgacctacgccgtcctccgtcacctacgtccgtccgggctaccgacgccgtacggacggtacggacggtacgttagtaacttttaagttacgtttagttaacgtttactaaactttaacgtaaccgtaaacgtacgttacgtaaccgttaacggtttcggggttacggttaccggggcgggtaaccgggacgtacggtacgtcggtacccgtaccgtacgggtaccgcggtacccgtaacggtccgtacccggtcccccttcggtaacgtcccttccggttcccttcccccgtcccgttccg

SEQ ID NO: 274322 - DNA, 567 bp, Homo sapiens
  misc_feature: GYAE6OF01AMP2E.27.23.C01.1.454.CMB.1.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
  modified_base (446)..(446): a, c, t, g, unknown or other
  misc_feature (446)..(446): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggngctttataactttntctgttggtaccgacaggacccaggcactcgtccccaaactcattctttatgatgtcagtaactccggcccctaggggtttcngactcgcttctatggctcaagtctgcctacncggccctccctgacccatccgtccgggcctccngcctggaggacgagctgatttattattgtattcatatacaacngtagctacgttgggtcgtcgggcggagggaccaggcctggacccgtcgtacggtcgacggccctaagggcctccggcccccgttcggtcctacccgttctccggttccccctccttccccg

SEQ ID NO: 274323 - DNA, 737 bp, Homo sapiens
  misc_feature: GYAE6OF01C1SZS.27.23.C01.1.454.CMB.1.raw
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (407)..(407): a, c, t, g, unknown or other
  misc_feature (407)..(407): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtcctcctggacagtcgatcaccattctccgtgcactcggaacccncgatgacggtttggngactttattaactttntcttgttacggtaccgacaacggacccaggcacttcgtacccaaactcattctttatgatcgtcagtaacgtcggtcccctagggtttctgtactcgtcttctacgtggcctctaagtctacgcctacgccggtccctcccgtnaccgtacgtccgtcccgggccttccgacgtccgttaggaacgggtacgagggtccttaggtaacttttagttagtttacggttacgtttaccaagttaacttaaccgaaccctagggtacgtaaccgttacgggtttacgggtttacgggttccggggacgggtaccgggtaaccgtagggtaccttaccgggttacccggttaccgttaacgggtacccgtaaccgggtacccgtaaacggggtccccgttacccgggtccccccgttacgggttacccctaaccgtttcccgtttccccgggttaccccccgttccccgttaccccgg

SEQ ID NO: 274324 - DNA, 718 bp, Homo sapiens
  misc_feature: GYAE6OF01B30QL.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgacttataactttatcttgttcggtaccgacacggacccaggccactcgtaccccaactcatttctttatgatgtacagtaactccggccccgtagggtttctagtactcgtcttctagtcggctaccgtaagtctcgtccctacgaccgtccctccctacgacctactccgtcccgggcctccgacgtcccgtaggacggacgtacggtcgttagtatttaagttagtttagttaacgttcgtaattactaacaacgtagtacgtaaccgttacggtttggggtacggttaccggggacgggtaacgggaccgtagggtccgttaccgggtaacccggttcccggttaacgggttccgaaccgggtaccccggtaaaccggggtcccgttaccccgggtacccccccggtttacggttaccccgttacccgtttaccccggttccccggtttccccccggtccccgttacccccg

SEQ ID NO: 274325 - DNA, 667 bp, Homo sapiens
  misc_feature: GYAE6OF01BOT9B.27.23.C01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttgtgctttataactttntctgttgtaccgacaggacccaggcactcgtaccccaaactctatttctttatgtatgtactagtaactccggtccccgtaggggtttctgacttcgcttctagtcggctcaagtctcgcctacaccggtccctccctagaccctacgtccgtacccgggccttccgagtcccgtaggaacggacggaggtcgttagtaatttattagtttgttagttactaattaactaaccaaccgtaggtagtaaccgttacggtttggggttcggttaccgggacggggtacgggaaccgacgggtccgtcggtacccggttccgtacgggtaccgaacggaccccgaaggggtcccttcccggccccccgttacgggtcccacccgtttccgtcccgttcccccgcccgttaccccg

SEQ ID NO: 274326 - DNA, 739 bp, Homo sapiens
  misc_feature: GYAE6OF01BN6OC.27.23.C01.1.454.CMB.1.raw
  modified_base (240)..(240): a, c, t, g, unknown or other
  misc_feature (240)..(240): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctccgtgtctgggtcctccgtggacagtcgatccaccatcctcctgcctacgtcggaaccccgngtatcggtacggttggtcgtactttaattaaccttttatcgttggttacggtaaccgacgtaacggacccgaggcctaccgtaccgtacccctaaactctactttctttagtgtagttcgtactaagttaaccgtcccggtaccccgttagggtttcctagtacgttcgtcttactagtcgtcctaccgaagttccgtacgtacccgtaaccgaccggtcccttaccgtacgtacctacgtcccgtaccggtcctccgacgtccgtaggacggacgtagtacgtagtaatttagttagttcgttacttactaacgttactaaccgtaacgtagttacgtaacgttacggttggggtaccggttcgggacggtaacgggacctagggtaccgtaccggtaccgttaccggtacggtacccgacggtacccggacggttcccgtcccggtaccccgttacggtacctaccgttccgttccccggtacccgtcccgtaaccg

SEQ ID NO: 274327 - DNA, 731 bp, Homo sapiens
  misc_feature: GYAE6OF01AZ07S.27.23.C01.1.454.CMB.1.raw
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgctttaataactttntctgttggtaccgacaggacccaggcactcgtccccaaactcatttctttatgatgtcagtaactccggcccctagggtttctgtatcgtcttctagtcggctccaagtctgaccctacaccggtccctcccgtgaccctactccgtcccgggccttcccgacgtccctaggacgggaccgaggtcttacggtaattttaagtttactttaggttacgtttactaattaactaacctaaaccgtagttacggtaaccttacggtttacggggttcggtttaccggggaccggggtaacggggacccgtaagggtccgttacgggtaaccccggttaccggttaacgggttacccgaaccgggtacccccggtaaacggggtcccgttaccccggtccccccccggttaccgggttacccctacccggtttcccggtttaccccggtttcccccccggtccccctttacccccgg

SEQ ID NO: 274328 - DNA, 660 bp, Homo sapiens
  misc_feature: GYAE6OF01BVOE7.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggncttataactttntctgttgtaccgacaggacccaggcactcgtccccaaactcattctttatgatgtacagtaactccggcccctaggggtttctgtatccgtcttctagtcggctaccgaagtcctgccctacgaccggtccctccctagaccctactccgtccgggcctccgacgtcccgtaggacgggacggacggtctaggtaatttagtttacgtttggttacgttacgtaattacttaaccgaacctagttacgaaccgtacggtttcggggttacggttaccgggacgggtacgggaccgtagggtcgtacggtacccggttaccgtagggtccgacggtaccccgtaagggcccttccggcccccgttcggtccctaccttcccgttccggttcccccgccccgttacccg

SEQ ID NO: 274329 - DNA, 831 bp, Homo sapiens
  misc_feature: GYAE6OF01BFAW7.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaacccgngatgacgttggtntcttaataactttatcttgttcggtaccgacacggacccaggcactcgtaccccaaactctatttctttatgtatgtacagtaatcccggcccccgtaggggtttctgtatccgtcttctagtcgctcctaagttcctacgcccttaccgaccggtccctcccgtacgaccctactcccggtacccgggtcctacccgacgtcccgtaggaccgggaacggtacggtacttaggtaaactttttagtttacgtttaacggtttagtttaaccttaagttaaccgttaaaccgtaaacccgttaaacgggttacgtaaacccggtttacggggtttttacgggggttaccgggtttaccggggggaaccggggttaaccgggtaacccgggtaagggttaccccgggttaaccgggtaccccggtttaccggtaaccggggttaccccgtaaccgggtaaccccccggtaaacggggttcccccgttaacccccgggtcccccccccggtttacggggttacccccgttaacccggttttccccgtttacccccgggtttcccccccgttcccccgtttaaccccccggg

SEQ ID NO: 274330 - DNA, 634 bp, Homo sapiens
  misc_feature: GYAE6OF01CICRN.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (337)..(337): a, c, t, g, unknown or other
  misc_feature (337)..(337): n is a, c, g, or t
  modified_base (625)..(625): a, c, t, g, unknown or other
  misc_feature (625)..(625): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgctactcggaaccncgatgacgttggncttaataactttatcgtgttgtacgacaggaccaggcactcgaccccaaatctattcttatgatgacagtaactccggcccctaggggtttcngtagtccgtcttctacgtggacctaccaaggtctcgaccttacgaccggtccttccctagaaccctattccgacccgggtcctccgaacgtccgtagggacgggaacgtaggaccgttagtaactttattagtttaggttacttactaactaataacccaacgtagtactacgtacgtttgggtacgttccgggacgggaacggaccaggtcgtacgtaccggtccgtagtaccgacgtacccgaaggcctaccgccccgttcggtactcccgttcttccgttccccnccgtacccg

SEQ ID NO: 274331 - DNA, 799 bp, Homo sapiens
  misc_feature: GYAE6OF01DSU9W.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggtaggtttggggggggtctcaggaggcagcgctctcgggacgtctccaccatggcctggctctgctattcctcaccctctcactcagggcacagggtcctgggcccagtctgccctgactcagcctgcctccgtgtctgggtctcctggacagtcgatcaccatctcctgcactggaacccncatgacgttggtactacttaattacttatcttcgttaggtaccaacaacggtacccccgagaaccgtaccctaaccgtacccaaacttcgtaatttctttagtaggtactagtacgacgttaaccggtccccggtacccgttaaggggttttcctacgtacgtttccgtacttttccgtacggtccgtacctaacgtacgttcgtacgaccgtaccgtacccggtccccttcccgtacgaaccctacgttccgtacccgggtccgtacccgaccgtaccggtacggacgggaaacgggtacggtacgttacgtttaactttaagttttacgttacggttaacgtttacaacgttacctaaacgtaacgttaacgttaacgaaaccgttaacgggtttaacggtacgggtttacggggtacgggtaccgggaaccggtaccggtaacgttaacccgtacccgggtaccgttaccggtaaccgccgtacccggaaccggtaccgtccccgttccccggtacccggtccttaacccttcccgttacccgttccccgtaaccccgttacccg

SEQ ID NO: 274332 - DNA, 790 bp, Homo sapiens
  misc_feature: GYAE6OF01ACVIM.27.23.C01.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctcctgcactggaacccgngatgacgttggntcttatacttntctgtgtacgacaggaccaggcactcgtaccccaactctattctttatgatgtcagtaacgtccggccccgtagggtttctgtactcgtcttactagtcggtcctaccgtaacgtctcgacccgtaccaccggtccctccctacgaccctacgtcccgtcccgggtaccctaccgaccggtacccgttacgggaacgggtaccgggtacggtaccgtttaggttaacttttaagttttaacgtttacggtttaacggtttacctaaacgttaaccgttaaaccctaacccggtaaggtttaccgtaaccggtttaccggttttacggggggttaccgggtttaccgggggaaccgggtaaccggggtaacccgtacggggttacccgttaccgggttacccggttacccggtttaaccgggtacccgtaaccggtacccccggtaaacgggtccccttaccccgggtaccccccccgttacgggttacccctaccgtttccccgttccccgggttaccccccgtccccgttacccccgg

SEQ ID NO: 274333 - DNA, 764 bp, Homo sapiens
  misc_feature: GYAE6OF01CFDTX.27.23.C01.1.454.CMB.1.raw
  modified_base (213)..(213): a, c, t, g, unknown or other
  misc_feature (213)..(213): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcctggacagtcgatcaccntcctcctgcacgtacggaacccgcgaatcggtacggtttggtacgtactttaattaacttttatcgttggttacggtaaccgacgaacggacccaggacctacgttcgtacccccaaacttctaacttttctttagtcgtattcgtactaacggttaaccgtcccggtacccccggttaaggggtttcctaggtacgttccggtactttacttagtcggtccttaacgtaacgttctaccggaccctaccggtacccggtccctacccgtcgaacctacgtcccgtccgggcctaccgacgtccgtacgggacggacggtacgtcgttacgtaatttaacgtttgtttacgttacgttactaattaaccgaactaacgtagtcgtaaccgttggttagggttcgggttacgggacgggtacgggaacccgtaggtaccggttaccggtacccgttacggtacggccgtaaccggacccggtaacggtccccgtccccggtacccgttaccggcccttaccttcccgttacccgtcccccgtcccgtacccg

SEQ ID NO: 274334 - DNA, 775 bp, Homo sapiens
  misc_feature: GYAE6OF01AMAFD.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaacccgngatcggacgtttggtctactttaataacttttatcgttggttcggtaccgacgtacggacccaggcctactccgtacccctaaactcctactttctttacgtgtatcgtacgagttaacgtccgggtacccccgtaggggtttctagtactccgtcttacgtagtcggtacctaccgtaagtccgtcgtacccgtaaccgtacccggtccccttacccgtacgtaacccgtacgttccccggttacccggggtacccttacccggtaacgggtccccggttacggggaacgggtaccgggtaacggggtaccttaaggttaacttttaagtttaacgtttacggtttaacgtttactaacttaacgtaaccctaacgtagtacgtaacgttcgggtttagggttacggttcgggacggacgggtaccgacggtccgtacggtacccgtacgtacggtacgaccggtacccgtaacggtcccgtcccgtccccgttaccggtaccgtacccgtttcccgtccccggttccccgtcccgttacccg

SEQ ID NO: 274335 - DNA, 640 bp, Homo sapiens
  misc_feature: GYAE6OF01C8X4F.27.23.C01.1.454.CMB.1.raw
  modified_base (356)..(356): a, c, t, g, unknown or other
  misc_feature (356)..(356): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatggacgttggtgtctttaataacctttatcttgttcggtaaccgacacggacccaggccacgtcgtaccccaaactctatttctttatgatgtcagtaacgtccggtccccgtagggtttcngattccgtcttctatcggctaccgtaagtctcgaccctaccgaccggtccctcccgtgacctatcccgtccgggcctccgacgccgtaggacggacgaggctagtatttattagttgtagttactattactaactaacgtagtacgtaaccgtacggtttacggggtgggttcgggacgggtacgggaccgtagggcctacggtacccgtcgtaggtccgacggacccgtaaggccgtccgtcccccgtcggtcctacccgtccgttccgtccccgccctcccg

SEQ ID NO: 274336 - DNA, 804 bp, Homo sapiens
  misc_feature: GYAE6OF01DYHJN.27.23.C01.1.454.CMB.1.raw
  modified_base (252)..(252): a, c, t, g, unknown or other
  misc_feature (252)..(252): n is a, c, g, or t
  modified_base (326)..(326): a, c, t, g, unknown or other
  misc_feature (326)..(326): n is a, c, g, or t
tcagagcgtcgtctcacgaccggtgctcgatttagtacacgtgattagggagttgggggggggtctcaggaggcagcgctctcgggacgtctccaccatggcctgggctctgctattccctccacccctcctcactcagggcacgagggtcctgggcccagtctgccctgactcagcctgcctcgtgtcgtgggtctccgtggacagtcgatccaccatctcctgcacgtcggaaccgcgatgtacgttggntacttaataactttatcgttgttacggaccgacgacggacccagccactccgtacccaaatcttatttctttangtatgtacgtaagtaacgtcccgggtacccgttaggggtttcagtacgttccgtcgttttacgtacgttacggtaccttaaccgtaaacgttccgttaccggtaacccttaaccgtacccgggtccccttaccccggtagtaaccccgtacgttccccggtacccgggtcccttaacccgacggtacccgtaaggggacggaaacggtcggtacttaaggttaacttttacgtttacgtttaggtttaacttctaaacgtttaacctaaaccgtaaacgttgggtaacaaccggtttggggtttacgggttcgggtaccgggtacggggaacgggtacccgtagggtacccgtaacgggtacccgtttaccgtaacgggtcccgaaacccggtacccgtaagggttcccctaaccccgggttccccggtacgttccctaaaccgttccctttaccccggtcccccttcccgtacccgg

SEQ ID NO: 274337 - DNA, 612 bp, Homo sapiens
  misc_feature: GYAE6OF01D4P33.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggactctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngctttataactttatctgttggtaccgacaggacccaggcactgtaccccaaatctatttctttatgtatgtcagtaactccggacccctaggggtttctgatcgtcttctatggctaccaatctgcctacgaccggcctccctgaccatccgtcccgggctacccgaagccctagacgggacagtcgtacgtattactttatttagttagttactaataactaacgtaacccacgtagaactacgttacgggttgggttcggtccggggacgggacgtacggcggtacgtacgtaccgtacgttcgacgacgaccggtcgtaccgtccccgtaccgtccgtacctacgttccgttccctccccgtacccg

SEQ ID NO: 274338 - DNA, 680 bp, Homo sapiens
  misc_feature: GYAE6OF01DT23H.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacacggacccaggccactcgtaccccaaactctatttctttatgatgtcagtactccggcccctagggtttctgactcgtcttctagtcggctccaagtcctgcctacgaccggtccctcccgtcgaaccctacgttccgtcccgggtcctacccgacgtcccgtagggacgggacgacggtctagttaattagtttagttggttacgtttctaacgttaactaaccgtaaccgtaggttacgaacttacgggtttcggggttgttaccggggacgggtaacgggtacccgagggtcctacggtacccgtccgttaacggccgtacggtacccgaacggtcccttacccgggtccccccgttcgggttaccctaaccgtttccccgttccgttcccccgtaccccgtccccg

SEQ ID NO: 274339 - DNA, 627 bp, Homo sapiens
  misc_feature: GYAE6OF01A5FHH.27.23.C01.1.454.CMB.1.raw
  modified_base (230)..(230): a, c, t, g, unknown or other
  misc_feature (230)..(230): n is a, c, g, or t
  modified_base (340)..(340): a, c, t, g, unknown or other
  misc_feature (340)..(340): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactcgtccccaaactctattctttatgatgtcagtaatccggcccctaggggtttctgntcgcttctatggctccaagtctgccctacaccggtccctccctagacccatccgtccgggctccacgtccgtggacggacgaggctagtaatttattagttagttacgttactaattactaactaacctagtacgactaacgttggggttcggttccgggacgggtacgggaccgaggtccgtcggtacccgtccgtacggtccgacggtacccgaaggtcccgtaccggtcccccccgttcgggtaccctacccgttccgttcccgttcccccgtccccttacccg

SEQ ID NO: 274340 - DNA, 690 bp, Homo sapiens
  misc_feature: GYAE6OF01D6X8S.27.23.C01.1.454.CMB.1.raw
  modified_base (243)..(243): a, c, t, g, unknown or other
  misc_feature (243)..(243): n is a, c, g, or t
  modified_base (613)..(613): a, c, t, g, unknown or other
  misc_feature (613)..(613): n is a, c, g, or t
  modified_base (682)..(682): a, c, t, g, unknown or other
  misc_feature (682)..(682): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcgtggacagtcgatcacctatcctcctgccaccgtacgggaaccccgngtaagtcggtacggtttggtcgtacttttaattaaccttttagttcgttggttacggtaacccgaccgaaccgggaaccccagggtacctaccgttaccgtaaccccctaaattccttactttcctttaatgtattcgtacgtaacggtaccgtcccgggtacccgtttagggtttctcgtacttccgtcttgtacgtcgtctacgtacgtctcgacctaccgccgtccgtcctacgactacgtccgtccgggctaccgcgtcgaggcggacgtcgtgtatacgtttattgttgtacttatacttacacgaacgtagacgtacgttacgggttcggtcgggttccgggacggtacgggacgtcgggtccncggtaccgtccgacgtcgaccgcgtacggtcctccccggtcccgtcgtccgtacctccgttcccgtccncccgtacg

SEQ ID NO: 274341 - DNA, 764 bp, Homo sapiens
  misc_feature: GYAE6OF01EUD5H.27.23.C01.1.454.CMB.1.raw
  modified_base (234)..(234): a, c, t, g, unknown or other
  misc_feature (234)..(234): n is a, c, g, or t
  modified_base (266)..(266): a, c, t, g, unknown or other
  misc_feature (266)..(266): n is a, c, g, or t
  modified_base (394)..(394): a, c, t, g, unknown or other
  misc_feature (394)..(394): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatcctctgcacgtcggaacccgngagtggacgttggtgtactttaattaactttntcttggttacggtaaccgacgtaacggacccgaggcctaccgttccgtaacccccaaattcctacttttacctttagtcgtattcggtactaaggttaaccgtcccgggtccccgttaggggttttcnggttactcgtctttacacgtcgtcctacgagtcctacgtacctaccggccgtacccctccgtacgaccctagttcccggtccggtcctaccgaccgtcgtacgggacggtacggtagtccgttagttaatttagtttacgtttaggtacgtttacaacgttacttaaccgtaaccgttagtacggtactttacggggttgggtccggggttaccgggacggggtaccggaacgtaccggggtccgttaccgggaccccgtttacgggtacgttacccggaccggtaccccggtacggtcccgttaccccggtaccccgttcgggtaccctaccccggttcccgtttccccgtcccctaaccgttacccgg

SEQ ID NO: 274342 - DNA, 547 bp, Homo sapiens
  misc_feature: GYAE6OF01ALXU2.27.23.C01.1.454.CMB.1.raw
  modified_base (335)..(335): a, c, t, g, unknown or other
  misc_feature (335)..(335): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataacttttatctgttggtaccgacaggacccaggcactgtccccaaactcattctttatgatgtcagtaatcggccccagggtttcngatcgcttctatggctccaagtctgcctacacggcctccctgacccatcctccgggctccagcctgacggacgaggctgattattattgtagttcatatacaacagtgacacgttgggtgttcggcgggagggaccaggctggaccgtcctaggtcaggcccaaggcctcgccccctcgggtccaccgtcctcgttccccgccccgttcccg

SEQ ID NO: 274343 - DNA, 626 bp, Homo sapiens
  misc_feature: GYAE6OF01BNND0.27.23.C01.1.454.CMB.1.raw
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccntctcctgcactggaacccgcgatgacgttggtnctttataactttatctgttggtaccgacaggacccaggcactcgtccccaaactcattctttatgtatgtcagtaatcggaccccgtagggtttctgatcgtcttctatggctcaagtctgcctacgacgcctccctcgaccactcgtccggctcccgacgtccgtgacggacgaggcgtacgtatttactttattgttagttactatactaacaaccgtagtacgtaactacggtttgggtgttccgggacgggtacgggtaaccgagggtcctacggacccggttacttacgggtaccgacggtaccccgaagggtcccctaccggtccccccgttacggttcccgaccgttacccgttccgttcccccgtccccttacccg

SEQ ID NO: 274344 - DNA, 757 bp, Homo sapiens
  misc_feature: GYAE6OF01AP81N.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaacccgcgatgacgttggtgcttataactttatctgttggtaccgacacggacccaggccactcgtaccccaaatcatttctttatgatgtcagtaacgtccggacccccgtaggggttttctggtactccgtctttacttagtcggtcctaccgtaagtcctcgaccccttaccgacccggtccccttacccctaggtaacccctacgttcccggttccccggggtccttacccgaccggtcccgttacgggaaccggggtaacccgggtaacgggtccgtttaggtaaacgttttttaactttaagtttcggtttaacgtttacttaacttaacttaacccgtaaaccctaggttacgtaacccgtacgggtttagggggttccggttaccggggacgggtaaccggggaccgtacgggtaccgttacgggtaccccgttccgttaacgggtccgaacccgggtcccgaacgggtccctccggccccccgttcggtacctacccgttccgtcccgtttcccccgcccttcccg

SEQ ID NO: 274345 - DNA, 768 bp, Homo sapiens
  misc_feature: GYAE6OF01C9DKP.27.23.C01.1.454.CMB.1.raw
  modified_base (229)..(229): a, c, t, g, unknown or other
  misc_feature (229)..(229): n is a, c, g, or t
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacagggtcctgggcccagtctgccctgactcagcctgcctcgtgtctggtctcctggacagtcgatcaccatctcctgcactcggaacccgngatggacgttggtgactttaattaacttttatcttgttcggtaccgacgacggacccaggcacgtcgtaccccaaactctatttctttangatgtacagtacgtccggcccgtagggtttcagtactcgtcttttancggtctacgaagttctcgtcctacgaccggtcccttaccgtcgtacctacgttcccggtcccgggccttaccgacgtcccgtagggaacggacggaggtcgttaagtaattttaagtttacgttcgttaagttccgtaaatttaacttaacccgaaacccgtaggttaccgtaacgtttaaccgggttttcgggggttacgggtttaccggggacggggtaaccggggtaacccgtaacggggtccttaacgggtaccccccgtttaacggtaccgggttaccgaacccggaccccggtaacgggttccccgttcccccgggtaccccccgttacgggttccccttaccgtttaccccggttccccggttttacccccccaccccgtttccccgtaaaccgg

SEQ ID NO: 274346 - DNA, 850 bp, Homo sapiens
  misc_feature: GYAE6OF01BYDZC.27.23.C01.1.454.CMB.1.raw
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
tcagagcgtcgtctcacgaccggtgctcgatttagtacacgtgattagggagtttggggggggttcgtcaggaggtcagcgctctcgggacgtctccaccatggcctgggactactgactattccctcacccttcctcactcagggcacgagggtcctgggccagtctgccctgactcagcctgcctccgtgtcgtgggtcctcctggacnggtcgatccaccatcctcctgcactggaacccngtatcgacggttggtcgactttaataactttntcgtgttacgtaccgacacggtaccaggcgactcgaccccaactcacttccgttagtcgatgtcgagtacgtccggacccgtagggtttcagtacgtcgtcttactactcggacctaccgtaacgtaccgtacgacccgtacgaccggtaccctaccgtacgaccctaacgtcccgtaccgggtacctaaccgtaccgtacccgtacgggtaaccggtaacggtaacggtccgttaaggtaacgttttaaacgtttaacgtttcgggttaaccgttaaccgtaacgttaaccgtaaaccgaaaaccccggttaggttaccggttaaccgttaaccgggttttacggggtttaccgggttaccggggacccggggttaaccggggaaccccgggtaacgggttacccgttccgggaaccccggttttacccggtacggggtttaaccccgtaaggggttaacccccggtaaacggggttccccttaacccggggtacccccccgtttaacggggttacccttacccgggttacccggtttaaccccgggttcccccgtacccccggtttacccgg

SEQ ID NO: 274347 - DNA, 649 bp, Homo sapiens
  misc_feature: GYAE6OF01DKLSG.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtncttatactttatctgttggtaccgacaggacccaggcactcgtaccccaaactcatttctttatgatgtcaagtaacgtccggcccccgtaggggtttctagtatccgtctttctatcggcctaccaagttctgccctacaccggtccctccctgacctatccgtcccgggcctcccgacgcccgtaggacggacggaggctagtaactttatttatttgttagttcaattaactaaccaacctagtcgaactacggtttgggtcggttcgggcgggtaacgggaccgagggcctacggtaccggtccgtacggtccgaacggacccgaacggtccccttaccggcccccccgttagggttccctacccgttcccgttcccggttccccccgtccccttaccccgg

SEQ ID NO: 274348 - DNA, 776 bp, Homo sapiens
  misc_feature: GYAE6OF01B2A5R.27.23.C01.1.454.CMB.1.raw
  modified_base (284)..(284): a, c, t, g, unknown or other
  misc_feature (284)..(284): n is a, c, g, or t
  modified_base (404)..(404): a, c, t, g, unknown or other
  misc_feature (404)..(404): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgccttcgtgtctgggtctccgtggacagtcgatccaccatcctcctgccacgtcgggaaccccgcgaagttcggtacggtttgggtcgtacttttaattaaaccgttttntccgttggtttacgggtaaccgacgacggacccacgggccacgtcgtaccccctaaaactcgtactttctttatgtaattgtacaaggttaactcccgggtaccccgtaggggttttccnggtacttccggtcctttactacgttcggaccttaccgtaacgttccgtacgtccccttaacgcccggttccccttccgtcgaacctcgttccgtcccggtcctacccgacggtcctagggaacggtaacggcggtactacggttaatttaacgttgtttacgttaacgttacttaacgttactaaccgaaccgtagttacgtaaccgttacggtttaggggttcggttacgggaccgggtaacggttcggaacgggtccgtaacggtccggttaccgtaaggttccgaccggtacccgaacggtccgttaccccggcccccgttaccggtaccctaccgttcccgtttccctcccccgtaaccccgttaccg

SEQ ID NO: 274349 - DNA, 733 bp, Homo sapiens
  misc_feature: GYAE6OF01B6S2B.27.23.C01.1.454.CMB.1.raw
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtcggaaccccgngatgacgttggtgtcttataactttntctgttcggtaccgacaggacccaggcactcgtaccccaaactcatttctttatgtatgtcagtaactccggccccgtaggggtttctgtactcgtctttcgtagtcggtctacgtaacggtctacgtccctaaccgaccggtccccttaccctacgaccctaccgttcccgtcccgggtcctaccgaccgccgttacgggacggtaacgggacggtcttacggttaatttaagtttagtttacggttacttacgtaacttaattaacccaacgttaagtacgtaaccgttacggtttcggggtcggttaccggggacggggtaacgggaccggtaggtcccgtacgggtaccggttaccgttacgggtaccgtaaccgggaccccgtaaacggggtcccttaccccgggtccccccgttacgggttaccctaccgttcccgttcccggttccccccgttccccgttaccccg

SEQ ID NO: 274350 - DNA, 703 bp, Homo sapiens
  misc_feature: GYAE6OF01CFYVC.27.23.C01.1.454.CMB.1.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (358)..(358): a, c, t, g, unknown or other
  misc_feature (358)..(358): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcacgtggaacccgnatgacgttggncttataactttntctgttggtaccgacacggacccaggcctactcgtaccccaaactctactttcctttatgtattacgtcgtaagtaacgtcccgggtccccgtaggggttttccngtacgtcgtcttctagtcggaccttaccgaacgttcctcgtaccctaccgtaccggtccctccctacgacctacgtcccgtccgggtctccgtacgccgtacgacggacgacgtcgtagtattagttagttgtagttcattaactaacaaccgtagtacgtacgtacggttcgggtggttaccgggacgggtacggaccgtacgggtaccgtaccggtacccggtccggttaacgggtcccgtaaccgggacccggtaacgggtcccgttcccggtcccccccggttacggttaccccgttacccttccgtttacccccgttccccccgtaccccgtttaccccg

SEQ ID NO: 274351 - DNA, 646 bp, Homo sapiens
  misc_feature: GYAE6OF01BGP9A.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttataactttatctgttggtaccgacaggacccaggcactcgtaccccaaactctattctttatgatgtacagtaactccggccccgtaggggtttcctgtacttcgtctttctatggtctaccgtaagtcctgccctaacgaccggtccctccctacgaccctacgtccgtcccgggccttacccgacgtcccgtaggacgggtacgaggtctagtaatttattagtttgtagttactaattactaactaaccgtagtgactacgtttgggtcggttcgggacgggtacgggaccgaggtccgtcggtacccgtcgtacggtccgacggtaccccgaaggtcccgtaccggcccccgttacgggtcctacccgttccttcccgttccccctacccgtcccg

SEQ ID NO: 274352 - DNA, 737 bp, Homo sapiens
  misc_feature: GYAE6OF01CFXXR.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccccgngatggacgttggtgtacttataactttatcttgttcggtaccgacacggacccaggcactcgtacccccaaactctatttctttatgtatgtctaagtaactccgggccccgtaggggtttctggatcgtcttctagtcggctactaagtctcgtccctacgaccggcccttcccgtagaccctacgtccgtcccgggctacccgaggtcccgtaggaacgggacggacggtctaggttaatttaagtttagtttacggttaacgtttctaattaactaaccgaaacccgtaggttaacggtaaccgtagggttttcggggttacggttccggggtaccgggaacggggtaacccagggtaccttaccggggtacccgttacccggtaacgggtaccgtaaccgggtaccccgtaaacgggtcccgttacccgggtcccccccgtttcggggtacccccttaccggtttcccgtttaccccgttcccccgtaccccgttaccccgg

SEQ ID NO: 274353 - DNA, 723 bp, Homo sapiens
  misc_feature: GYAE6OF01BMMMS.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtcggaacccgngatggtaccgttgggtacgtactttaataacttttatcgttggtttcggtaccgacgacggacccgaggcactcgtaccccaaacttctatttcctttatgtatgtactagtaacgtccggccccgtagggtttctcggtacttcgtcttcgtagtcggacctacgtaagttcctacgtccctacggacccgtcccttcccgacgaccctacgttcccggtcccggtcctaccgcgtaccgtaggacgggtacggacggtcgtagttaatttagtttacgtttagttacgttctaagttaactaaccgtaaccgtacgtacgtaacgttacgggtttcggggttcgggttaccgggacgggtacgggacccgtacgggtccgtaacggtacccggttcggttaacggccgtaccggtacccggaaggtcccgtaccccgtccccgttcgtaccgtaccgttcccgttcccgttcccccgtcccgttaccccg

SEQ ID NO: 274354 - DNA, 585 bp, Homo sapiens
  misc_feature: GYAE6OF01CA5NW.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttntctgttggtaccgacaggacccaggcactcgtaccccaaatcatttctttangatgtcagtaatccggcccctaggggtttcngtatcgtcttctagtcggctacaagtctgcctacacggccctcctgacctatcgtccggctccagcctggacggacgaggtctagtattattagtgtagttcatatacactagtgactacgttgggtcgttcgggacggaggaccgaggcctaggacccgtcgtacggtcgacggacccgaaggtccctaccggtccccccgttacgggtccaccgttccgtacccggttcccccgtcccttacccg

SEQ ID NO: 274355 - DNA, 811 bp, Homo sapiens
  misc_feature: GYAE6OF01C97YC.27.23.C01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctcgccctgactcagcctgcctccgtgtcgtgggtctccgtggacagtcgatcaccatctcctgcacgtcggaacccgngatcggtacgttggtgtacttattaactttatcgttggttacggtaccgacgacggacccaggcctacgtccgtaacccctaactcttactttctttatgtattcgtacgtaacggttaaccgtcccgggtaccccggttagggtttcctagtcgtccgtctttcgtacgtcggtacctaccgtaacggtcctaccgtaccctaccgacccggtcccttcccgtacgtaccctacgttcccggtcccggtcctccgtacgtccggtacgggacggtacggacggtcttaggttaacgttttaagtttacgttacgtttacgtttaactaactttaacctaaaccgtaaaccgtagttaccggttaacgttaccggggtttcggggttaccgggtttaccgggggaccgggtacgggtaacccggtcgggttaccggtaccgggtaccccggttaccggttaccgggaccgtaaccgggtaccccggtaacgggtcccccgttaccccggtcccccggttaccggtacccttacccgttcccggttacccccttccccgttacccccgtacccgg

SEQ ID NO: 274356 - DNA, 727 bp, Homo sapiens
  misc_feature: GYAE6OF01CZWR7.27.23.C01.1.454.CMB.1.raw
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (337)..(337): a, c, t, g, unknown or other
  misc_feature (337)..(337): n is a, c, g, or t
tcagagcgtcgtctcacgaccggtgctcgatttagtacacgtgattagggagttggggggggtctcaggaggcagcgctcgtcgggacgtctccaccatggcctggctctgctattcctcaccctcctcactcgagggcacgagggtccgtcgggcccagtctgccctgactcagcctgcctcgtgtctgggtctccgtggacagtcgatcaaccntcctctgacacgtacggaacccgngatggtacgttggngtactttaattaacctttntcgttaggttacggtaccgacgaacggaccgaggctactccgaacccaaatctactttacttangtatcgtactaacgtacgcccggtacccggttagggttctaggtactcgtcttacgtagtcggacctacgtaacgttctaccgtacctaaccggaccggtcccttacgtacgacgtaccgtccggtcccggtactccgacggcgaagggacggtacggagtcgttaagtactttaagtttagtacgtaattactaactaacggttaacctaacgtacgggttaactaaccggtaaggggttttcgggaccgggttacggggaaacccggggtaggaaaccggtggtaaccggtacccgtacggtaccgtaggtacccgaccgaccggtaacgtccgtcccccgtaccggtactacccgtattacccttacccggttcccacccgttacgg

SEQ ID NO: 274357 - DNA, 710 bp, Homo sapiens
  misc_feature: GYAE6OF01EYJBB.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaacccngatgacgttggntctttaataactttntcttgttcggtaccgacgacggacccaggcacttcgtaccccaaactctatttctttatgtatgtactaagtaacgtcccggaccccgttaggggtttctgtactcgtcttctagtcggcctacgtaagttcctcgtaccctacgacccggtccctaccctacgtacctacgtcccgtccgggtcctaccgacgccgtaggacggacggagtctagtaatttattagttaggtacgttactaacttactaacctaacctaggtacgtacgttaacggtttcggggttacggttaccggggacgggtaacgggaccgtagggtacccgttacggtaccccggttccgtaacgggttacccgaccggtacccggtaacgggtccctaccccgggtcccccgttaccggttacctacccgttacccgttcccggttccccccgtcccgttacccg

SEQ ID NO: 274358 - DNA, 694 bp, Homo sapiens
  misc_feature: GYAE6OF01DUZRJ.27.23.C01.1.454.CMB.1.raw
  modified_base (237)..(237): a, c, t, g, unknown or other
  misc_feature (237)..(237): n is a, c, g, or t
  modified_base (271)..(271): a, c, t, g, unknown or other
  misc_feature (271)..(271): n is a, c, g, or t
  modified_base (374)..(374): a, c, t, g, unknown or other
  misc_feature (374)..(374): n is a, c, g, or t
  modified_base (686)..(686): a, c, t, g, unknown or other
  misc_feature (686)..(686): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctctcactcagggcacagggtcctgggcccagtctcgccctgactcagcctgcctccgtgtcgtgggtctcctggacagtcgatcaccatcctcctgacacgtcggaacccgngatcggtacgttggtcgtactttaattaactttntcgttaggttacggtaccgacgacggaccaggcctactccgtacccctaaatctactttcttagtgtatgtactagtaacgtcccggtacccgttagggttcngtactcgtcttacgtagtcggtacctacgtaagttcgtaccgtccctaaccgcccggtaccccttcccgtaccgaaccttccgtcccgtcccgggtaccctaccggtaccgtaccgtacgggaacgggtacggaggtccttaaggttaatttagtttacgttggttaactagtactaactaaccaacgtagtacgtacgttaggttcgggtacggtcgggaggacggacgtaggccgtccgtaccggtcgtaggtaccgacgacccgacggcccgtcccgtcccgtcggtccaccgttcctccccgttcccnccgttccg

SEQ ID NO: 274359 - DNA, 715 bp, Homo sapiens
  misc_feature: GYAE6OF01EUQMQ.27.23.C01.1.454.CMB.1.raw
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
  modified_base (705)..(705): a, c, t, g, unknown or other
  misc_feature (705)..(705): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatcctcctgccacgtcggaacccgngatggtacgtttggtgtactttaataacttttntcgttgttcggtaccgacgacggacccgaggctactcgtaccccaaattctatttactttagtgtaattcgtactaaggtaacgtcccgggaccccgttagggtttctagtacttcgtctttacgtagtcggtacctaccgaagttccacgtaccctacgacccgtcccttcccgacgtacccgtacgtcccgtaccggtcctccgacgtccgtaggacgacggtcggtctagttaatttattagttacgttacgtactaattaacctaacgtaacgagttacgtaaccgttacgggtttcggggttacggttacggggacgggtaacgggtaccgagggtccgtacggtacccggttacgacggtaccgaaccggaccgtaacggtccgtaccccgtccccggtacggttcctacccgttcgttccccgttaccccnccccgtaccg

SEQ ID NO: 274360 - DNA, 567 bp, Homo sapiens
  misc_feature: GYAE6OF01EJMLB.27.23.C01.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (385)..(385): a, c, t, g, unknown or other
  misc_feature (385)..(385): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgctttataactttntctgttggtaccgacacggacccaggcactcgtaccccaaactctatttctttatgatgtcagtaactccgggaccccgtagggtttctgactcgtcttctagtgctcaagtctgcctacgcgcctccncgaccacgtccgtccgggctccacgcctgacggacgaggtctagtattattattgtatcatactacaacagtcacgtacgttgggtgtcgggcggacggacgaggctcggaccgtcgtaggtcgacgacccgaggcctccgcccccgtcggtcctaccgttctcccgttcccctcccgtccg

SEQ ID NO: 274361 - DNA, 751 bp, Homo sapiens
  misc_feature: GYAE6OF01EGNXJ.27.23.C01.1.454.CMB.1.raw
  modified_base (245)..(245): a, c, t, g, unknown or other
  misc_feature (245)..(245): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtcggaacccgcgatgacgttgggtntactttaataacttttatctaggttcggtaccgacgtaacggacccaggcactcgtacccccaaactctatttctttatgtatcgtactacgttaactccgggtaccccgtaggggtttctgatcgcttctatcggctcaagtctcgcctacgaccgcctccctagaccctagtccgtccgggcttcccgacgtccgtaggacggtacggtaggccttaggtactttaacgtttagtttacggttacgtttacaagttaactaaccgtaaccgtagttacggtaaccgttacggtttcggggttacggttaccggggaccgggtaacggggtaaccctacggggtacccgttaccgggtaaccccggtttccggtaacggggttacccgtaaacgggtacccccgtaaaggggttaccccttcccggggtacccccccgttaccggggtacccttacccgtttaccccgttcccgggtttacccccccgtccccctttaccccggg

SEQ ID NO: 274362 - DNA, 671 bp, Homo sapiens
  misc_feature: GYAE6OF01CJA16.27.23.C01.1.454.CMB.1.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (327)..(327): a, c, t, g, unknown or other
  misc_feature (327)..(327): n is a, c, g, or t
  modified_base (357)..(357): a, c, t, g, unknown or other
  misc_feature (357)..(357): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtcctccgtggacagtcgatcaccatcctcctgccacgtcggaaccccgngatcgacgtttggngtacttataacttttatcttggttcggtaccgactaggacccaggcactcgtaccccaaactcatttctttatgtntgtcagtacgtcccggcccgtagggtttcngatcgtcttctagtcggacctacagtcgtcgccctacgaccggtccctcccgtagaccctacgtccgtacccgggctaccagtcccgtaggaacggtcgacggtctagtaactttaagttacgtttaggttattaccaagttaacctaacgaaccgtaggtacgtaccgttagggtttgggtcggttacgggacggtacggaccgtagggtcctacggtacccgtccgtagggtaccacggacccgtaacggtccgtacccgtccccccgttggtacctacccgttacccgtcccttcccccgtcccgttaccg

SEQ ID NO: 274363 - DNA, 780 bp, Homo sapiens
  misc_feature: GYAE6OF01BR2G3.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaacccgngatgacgttggtgtctttaataacttttatcttgttcggtaccgacacggacccaggcactcgtacccccaaactctatttctttatgtatgtcagtaactcccgggcccccgtaggggtttctgtactcgtaccttctagtcggcctaccgtaagttcctgacccctaccgaccggtccccttccctacgtaccctacgttccccgtcccgggtcctcccgacggtcccgtagggacgggtaccggacgggtccgttacggttaattttaacgttttagtttacggtttaacgtttaccgtaaacttaactaacccgtaaaccgtaggttaacgtaaccgttacgggtttcggggttcgggtttaccgggggaccgggggttaacgggacccggtagggttcccggttacggtaaccccggttcccggttaacgggttacccgaaccggtaccccggtaacgggtccccgttaccccggtcccccccggttccggtaccctacccgtttcccgtttccccggttcccccccgtccccggttacccccg

SEQ ID NO: 274364 - DNA, 686 bp, Homo sapiens
  misc_feature: GYAE6OF01A4ZRZ.27.23.C01.1.454.CMB.1.raw
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
tcagagcgtcgtctcacgaccggtgctcgatttagtacacgtgattagggattggggggggtctcaggaggcagcgctctcgggacgtctccaccatggcctggctctgctattcctccaccctcctcactcagggcacgagggtcctgggcccagtctcgccctgacctcagcctgcctccgtgtctgggtctccgtggacagtcgatcaccatctcctgcacgtggaacccgngatgacgttggnctttaataactttatcttgttcggtaccgacgacggacccaggcactcgtaccccaaactctaatttctttatgatgtcaagtaactccggcccccgtaggggtttcctggtactcgtcttctagtcggcctacctaaaggttcctcggtacccttacgaacccggtccccttccccgttacgaccctacgtcccgtcccgggtcctcccgacggccctaggacgggacgaggtctagtaatttacttagttagttagtttcaattaactaacctaaccgtagtacgaacgtacgtttggggtcggttaccgggcgggtaacggggaaccgagggtccgtcgggacccgttaccgtaggttaccgacggtacccgaacgggtcctacccggtcccccgtacgttcccgacccttccgtccccgttcccctccctacccg

SEQ ID NO: 274365 - DNA, 694 bp, Homo sapiens
  misc_feature: GYAE6OF01CJVUO.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccccgngatcggtacgttggtgactttataacttttatcttgttggtaccgacacggacccaggccactcgtaccccaaactcatttctttatgatgtcagtaactccggcccctaggggtttctgactcgtcttctagtcggctccagtctgcctacgaccgtccctcctcgacctactcgtcccgggctacccgagtcccgtaggacgggacgacggtcgttagtaacgttttaatttagtttcggttaagtttactaatttaaccgttaacaaacccgttaggttacgaaccgttacggttttacgggggttaggttccggggacgggtaacggggtaccgacgggtccgttacggtacccggttaccgtagggtacccgaacgggaccccgaacgggtcccttacccgggtccccccgtcgggttaccacccgttccgtttcccgttccccgtccccgttacccg

SEQ ID NO: 274366 - DNA, 715 bp, Homo sapiens
  misc_feature: GYAE6OF01EKIKQ.27.23.C01.1.454.CMB.1.raw
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgtctttaataactttntcttgttacggtaccgacgacggacccaggcactcgtaccccaaatctatttctttatgtatgtacagtaacgtccggtaccccgtagggtttctagtactcgtcttctagtcggtctaccgaagttctacgtccctaaccgaccggtcccttacccgtacggtaaccctacgttcccggtcccgggtccttacccgaacgtcccgtaggacgggacgtaggtccttaggtaactttatttagttgttaacgtttactaagttaactaaccgaaccgtagtacgtaaccgtaggtttcggggtggttaccgggacgggtacgggaaccgtacgggtcctacggtacccgttaccgtacgggttaccgaaccgggtaccccgtaagggtcccgtacccggtccccccgttacggtaccctaccgttcccggtttcccgttccccccgcccgttacccg

SEQ ID NO: 274367 - DNA, 677 bp, Homo sapiens
  misc_feature: GYAE6OF01DQ19Y.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgtcttattaactttatctgttcgtaccgacacggacccaggcactcgtaccccaaactctatttactttatgtatgtactagtaactccggaccccgtagggtttctgatcgcttcgtatcgctacatctcgcctacgcgccctcctacgacccacttccgcccgggtacctccgacgtccgtacggaacgggtacggacggtacgttagtaacgttttaagttacgtttaggttacgttacctaataacttaaccaacgtacgtagtacgtacggtttggggtacggttacgggacgggtaccgggtacgacggtcgtaccggtcccggtaccggtacggtaccgaccggtacccgaacgggtcccgaccccggtcccccgtccgggttaccctacccgttccgttacccgttccccccgtacccgttaccccg

SEQ ID NO: 274368 - DNA, 794 bp, Homo sapiens
  misc_feature: GYAE6OF01BNIMQ.27.23.C01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgccacgtcgggaaccccgngaagtcggtacggtttggtcgtacttttaattaaacttttagtcgttggtttacggtaacccgacgtaaccggacccaggcctaccttccgtaccccctaaaactcctaattttctttatgtattcgtacgtaacgtaaccgtcccgggtaccccggttagggtttcctagtacgttccgtcttactacgtcggtacctaccgtagttcctacgtacccgtaccgtacccggtcccttacccgtacgtacccgtacgttcccggtccgggtacctaccgacgtccggtaggaacgggacgtacggtacgtagttaagtttaacttagttacgttaacttacgtaaattaacgtaaccgtaacgtgtaacgtacgttacggtttcggggtacggttaccgggacgggtaacggaccgtacggtaccggtaccgtacccggtccgtaacggtaccgtaccggtaacccgtaaccgggtccccttccccgggtacccccgttacggttacccttaccccggttcccgtttcccccggttcccccgttccccgtaacccgg

SEQ ID NO: 274369 - DNA, 883 bp, Homo sapiens
  misc_feature: GYAE6OF01BO2B3.27.23.C01.1.454.CMB.1.raw
  modified_base (304)..(304): a, c, t, g, unknown or other
  misc_feature (304)..(304): n is a, c, g, or t
  modified_base (378)..(378): a, c, t, g, unknown or other
  misc_feature (378)..(378): n is a, c, g, or t
tcagagcgtcgtctcacgaccggtgctcgatttagtacacgtgattagggattgggggggggtctcaggaggcagcgctctcgggacgtctccaccatggccgtggctctgcttattccctccaccctcctcactcgagggcacgagggtcctcgggcccagtctcgccctgactcacgcctcgccctcgtgtcgtgggtcctccgtggactaggtcgactaccacctatccttccgtgacctaccgtacgggaaccccgcgtaagtcggtacggtttgggtcttaactttaacttaaactttnttcgttggttacggtaaccgaacgacggacccgaggccacgttaccgtaacccctaaactcttactttcttagngttactcgtacgtaacgtaccgtcccgggccccggttagggtttctacgtacgttccgtccttagtacgtcggtacctacgtacgtcgtaccgtaccgtaccgaccggtccccttaccgtactaccgtacgtcccggtccggctaccgacggtcccgtaggggaaccggtacggtacgtcgttaagttaacttttacgttagttttacgggttaccttaacgttaaacttaaccgtaacccgtaacggttaaccgggtagttaacccggtttacggggttttcgggggtaccggggtttaacggggacccggggttaaacggacccgggtacgggttacccgttacccgggttaccccggtttacgggtaacccgggtaccggtaaccccggtaaccccgggtaaaggtccccccgttacccccgggtcccccggttaaccggttacccgttacccggtttaccccgtttccccccggtttcccccgtcccccgttaaacccggg

SEQ ID NO: 274370 - DNA, 669 bp, Homo sapiens
  misc_feature: GYAE6OF01BRTMA.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgcctgggtctcctggacagtcgatcaccatctcctgcactggaacccngatgacgttggngcttataacttttatctgttggtaccgacacggacccaggcacctcgtaccccaaactctattctttatgtatgtcagtaatccggcccccgtaggggtttcctgtacttcgctttcgtagtcggtccttaccgaagttcctcgaccctacgtaccggtccctaccccgtgaccctacttccgtcccgggtcctacccgacggtccctgggaacgggtacggacggtcctgttaactttatttacgtttgttaagtttaccaattaactaacctaaccgtagtacgtaactacggtttggggtcggtttcgggacgggtacggggtaccagggtccgtcggtaccgtccgtaaggtccgcgacccggtaaggcccgttccggccccccgtggtccctaccttccttcccgttccccctacccttcccg

SEQ ID NO: 274371 - DNA, 906 bp, Homo sapiens
  misc_feature: GYAE6OF01ES9C1.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgcactgactcagcctgcctcgtgtctgggtctcctggacagtcgatcaccatcctcctgcacgtcggaacccgngagtcgtacgttggtgtaccttaattaactttatcgttggttacggtaccgacacggacccaggcctactcgtaccccaaactctatttcttatcgtatgtactagtaaccgtccgggtaccccgtaggggtttctgtacgtccgtcttacgttacgtcggtacctaccgtaacgttccgtacgtaccccgtaaccgaccccggttccccttaccccgtacgaacccgttaccgttccccggtaccccggggtcccttaccccggtaccggtacccgttacggggaaccgggtaacccgggtaacgggtcctttaaggtttaacgtttttaacgttttacggttttacggttaaccgtttaacctaacgtttaaacccgtaaacccgtaaaccgttaacgggttaccgttaaacccggtttaccgggtttacggggggtttaccgggtttaccggggggaacccggggttaaccggggtaacccggtacggggtaccccggtttaaacccgggttaccccggttacccgggttaaaccggggtcccggtaaacccgggtacccccggtaaaggggttccccccgttaacccccgggtccccccccggtttacgggttacccccttacccggtttccccccgtttccccggttaacccccccttaccccccgg

SEQ ID NO: 274372 - DNA, 723 bp, Homo sapiens
  misc_feature: GYAE6OF01EXRJ9.27.23.C01.1.454.CMB.1.raw
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctcgtgtcgtgggtctcctggacagtcgatcaccatctcctgcactggaacccgngatgacgttggtgtctttaataactttntctgttcggtaccgacacggacccaggccactcgtaccccaatctatttctttatgtatgtcgtaagtaacgtcccgggacccccgttaggggttttctaggtacgttccgtccgtttactacgttcggtccttaccgaaacgtttccgtcgtaccccgttaaccgacccggtccccttacccccgtgtaacccctacgttcccggtccgggtcccttaccgacgtccgtagggaacgggacggtacggtcgttagtaagttttaatttacgtttagtttacttactaacttaacgtaactaaccgtagttacgaacgttacgggtttgggtacgggttcgggacgggtaacggaccgacggtccgtcgtacccggttacgtacggtacgaaccggtacccgaaggtcccgtcccgtccccgtcggtcctaccgttcccgttcccgttccccgtccccgtaccg

SEQ ID NO: 274373 - DNA, 741 bp, Homo sapiens
  misc_feature: GYAE6OF01EUNX1.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcatcaccatcctcctgcacgtacggaacccgngagtggacgttggtcgtactttaattaacgttttatcgttggttacggtaccgaacgacggacccagggcctacgttacgtaacccccaaacttcttaacttttcctttaagtgtacgttgtactaaacggtaaccgttccccgggtacccccggttaggggtttctacggtacttccggttacttcgttagtcggtacctaccgtaagttccgtcgtaccctaccgacccggtccctaccccgtgaccctacgtcccgtcccgggtcctccgaccgtccgtagggaccggacggtacgtcgtacgttaatttacttagttacgttgttactaacgttactaaccgtaacgtcgtacgaaccgttacgggttgggtacgggttacggaacgggtacggaccgtaggtctaccgggaccttacgtacggtaccgaccggtacccgacgtcccgtaccccgtcccggttcgtaccctcgttccccggttcccgtccccgtccctaccgg

SEQ ID NO: 274374 - DNA, 690 bp, Homo sapiens
  misc_feature: GYAE6OF01AF7S6.27.23.C01.1.454.CMB.1.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtcggaacccgngatggacgtttggtntacctttaattaacttttatcgttgttcggtaaccgacgacggtacccaggcctacgtacgtaccccaaactctactttctttatgattcgtacgagttacgtcccgggtccccgtagggtttcagtactccgtcttctagtcggtcctacgtacgtccgtcgacccgtacgacccggtccctcccgtcgtaaccctcgttcccgtcccgggtacctccgacgtccgtaggacggacggtacgtcgttagtaactttagttagttagttacgttactaactactaaccaacgtagtacgacgttacggttgggtcggtcgggacgggacggtaccgtagtccgtcgtaccgttccggtacgtaccggaccggacccgtaacgtcccgtacccggtcccccgttcgtacctccgttaccctaccccgttccccgtcccctccg

SEQ ID NO: 274375 - DNA, 667 bp, Homo sapiens
  misc_feature: GYAE6OF01DW5K9.27.23.C01.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (655)..(655): a, c, t, g, unknown or other
  misc_feature (655)..(655): n is a, c, g, or t
tcagagcgtcgtctcacgaccggtgctcgatttagtacacgtgattagggattgggggggtctcaggaggcagcgctctcgggacgtcctccgaccatggcctgggctctgctattcctcaccctcctcactcagggcacagggtcctgggcccagtctgccctgactcagcctgcctcgtgtctggtctcctggacagtcgatcaccatctcctgcactggaacccngatgacttggtncttatactttatcgtgttggtaccgtacaggaccctaggcactcgtacccaaactcgtattctttaatgtattcgtacacgtaactccggccccgtaggggtttcctgtactcgtcttctatggtctcctaagtctcgccttaccaccggtccctcccgtcgacctagttccgtccgggtccttacccgaaggcccttagggaacggaaccggtacgggtcctaggtaatttagtttagttcgttagttacagtaacttaacaacctgtacaacgttcgttacgggtgttaccgggacggacgggaccgtacggacgtaccgtaccgttaccgtagggtcccaacgggtacccgaacggtcccttcccggtccccccgttcgggtccctaccgttcccgttacccgttacccccncccgttaacccg

SEQ ID NO: 274376 - DNA, 589 bp, Homo sapiens
  misc_feature: GYAE6OF01CUZN4.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (419)..(419): a, c, t, g, unknown or other
  misc_feature (419)..(419): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtncttataactttatctgtgtaccgacaggacccaggcactcgtaccccaaactcattctttaatgactgtcagtaatcggccccaggggtttctgtatcgcttctatggtctaccgtaaagtctgacctacgacggtccctcctcgacctactctaccgggctccagcctgaggacgngctgattatattgtagttcatatacaacagtcgactacgttgggtcgttcggacgggtaggacgaggcgtacggtaccgtccgttaggtacctaacggacccaagggtccctaccggtccccccgtacgggttaccctaaccttccgttcgttcccccgtcccctacccg

SEQ ID NO: 274377 - DNA, 665 bp, Homo sapiens
  misc_feature: GYAE6OF01ADIKA.27.23.C01.1.454.CMB.1.raw
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatccaccatcctcctgcacgtcggaacccgngatgacgttggtgtcttataactttntctgttcggtaccgacgacggaccaggccactcgtaccccaaactcactttactttatgtattcgtactaagttaaccgtcccggacccccgttagggtttctacgtactccgtcctttctagtcggtctaccgaagtctcgaccctaccgaccgtccctccctcgacctacgtccgtccggtcctccgacgccgtaggacggacgacggtctagtactttagttacgttgttaacgttactagtaactacgaacgtagtacgtacctacggttgggtacgggttcgggaccgggtacggtacgtacggtcgtaccgtaccggttaccgacggtccgacggacccgtacggcccgttcccgcccccgttcgtacctaccttccgttccccgtcccctccccgtacg

SEQ ID NO: 274378 - DNA, 943 bp, Homo sapiens
  misc_feature: GYAE6OF01DOVAY.27.23.C01.1.454.CMB.1.raw
  modified_base (172)..(172): a, c, t, g, unknown or other
  misc_feature (172)..(172): n is a, c, g, or t
  modified_base (248)..(248): a, c, t, g, unknown or other
  misc_feature (248)..(248): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgactcngcctgcctccgtgtcgtcgggtctccgtggacagtcgactccacctattcctcctggaccacgtaccgggaacccngtagtggtaccggtttggtacgttacttttaacttaaacttttcttcgttacgggtttaccggtaacccgaacgaaccgggtaaacccgacggaccgtaaccgttccgtaaacccccctaaaacttccgttaacttttacctttaagtcgtacgttagtaccgttaagtaaaccggtcccggtacccccgggttaaggggttttcctaggtacttccggttacttttacgtacgtaccggtacctaccgtaacgttccgtaccgtacccgtaacccggaaccggttcccctacccgttaccggaacctccgttacccggttcccgggtacctacccggtaccgtaccggtaaggggaaccggacgggtacgttagttaacgttaacgttttaagtttcgttaaggttaccttaactaattaacccgtaaactaaccggtaagttacgtacccggtttaaggggtttcggggtttaccggggtaaccggggtagggggtaaacccgggtaaccggacgggtttcccgtaaacccgggtttaccccggaaccgggtttaacggacccgggtaaacccgtaccccggggtaaaccgtccccgggttaccccggtcccccccggttaaccccgggttactttaaacccccggttcccgtttcccccccggttaacccccgtaaccccggttaccccccg

SEQ ID NO: 274379 - DNA, 856 bp, Homo sapiens
  misc_feature: GYAE6OF01CBBB4.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcacgtcggaacccgcgatcggacgtttggtgtacctttaattaaacttttattcgttcggttacggtaacccgacgaacgggacccaggtcctaccgtccgtaacccccaaaacttctaacttttaccttttagtgtacgttgtaccgtaacggttaaaccgtcccgggtacccccggttagggggttttcctacggttacgttaccgttcctttcgtaacgttcggtaccttaccgtaacgttccgtaccggtacccctaaaccggtcccggtaccccttccccgtaccggtaacccctacgtccccggtacccgggtccctacccggtacggtacccgtagggaacgggtaacggacggtaccgttagttaattttacgtttaagtttacgggtttaacttacgtaaattaactaaaccgaaacccgttaagttacggtaacgtacgggttttacgggggtacggttccggggaccggggtaacgggaaccccgtagggacccgttacgggtacccccggttacggtaacgggtcccgaacggtaccccggaagggttcccctaccccgggtacccccgttaccgggttcccttacccgggttccctttccccggttaccccctcccgttaccccgg

SEQ ID NO: 274380 - DNA, 718 bp, Homo sapiens
  misc_feature: GYAE6OF01AWKBE.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaacccgngatggacgttggtgactttataacttttatcttgttcggtaccgacacggacccaggcactcgtaccccaaactctatttctttatgtatgtacagtaacgtccggccccgtagggtttctgtatcgtcttctagtcggactacagtctcgcctacgaccgtccctccctacgacctacgtcccgtccgggtctacccgacgtccgtacgggaacggacggtacggtcgttagtactttaacgtttagtttagttacgttactaagttactaaaccctaaccgtagttacggtaaccgttacggtttcggggttacgggttaccgggacggggtaaccggggtacccgagggtccgttaccgggtaacccgttaccggttacgggtacccgaccggtaccccgaacgggtccccgttccccggtccccccggtttccggtaccgttacccttcccggtttacccgttccccccgttaccccgtaccccg

SEQ ID NO: 274381 - DNA, 711 bp, Homo sapiens
  misc_feature: GYAE6OF01DLBFP.27.23.C01.1.454.CMB.1.raw
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctctcactcagggcacaggggtcctgggcccagtctgccctgactcagcctgcctcgtgtctgggtctcctggacagtcgatcaccatctcctgcactcggaacccgnatgacgttggnctttaataactttatcgttggttcggtaccgacgacggacccaggcactcgtaccccaaactctatttctttangtatgtcaagtaacgtccgggtccccgtaggggtttcngtatcgtacttctagtcggtactaccaacgtctacgccctaacgcccggtccctccgtacgaccacgttccgtcccgggtcctccgacgtcccgtacggacgggaacggaggtcgtagttaactttagtttagtttacggttaacgtttacgtaacttaactaacctaaccgtagttaacgaacgtttacgggttcggggtttagggttccgggtacggggtacgggacccggtaggtaccggttacggtacccggtccgtacgggtaccgtaccggtacccgaacggtcccgtacccgtccccggttccgtacccgtaccgtttcccgttcccggttccccgtccccgttaccccg

SEQ ID NO: 274382 - DNA, 688 bp, Homo sapiens
  misc_feature: GYAE6OF01AU4NC.27.23.C01.1.454.CMB.1.raw
  modified_base (261)..(261): a, c, t, g, unknown or other
  misc_feature (261)..(261): n is a, c, g, or t
  modified_base (317)..(317): a, c, t, g, unknown or other
  misc_feature (317)..(317): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaacccgcgatggacgttggtgtactttaataactttntctggttcggtaccgacacggacccaggcctactcgtaccccaatctatttcttangtatgtcagtaacgtcccggaccccgttagggtttcagtacgttcgtctttacgtagtcggtacctaccgtaacgttccgtacgtacccgttaaccgtacccggtccccttacccgtacgtaacccgtaccgtcccggtcccgggtaccctaccgacggtccgtagggacggtacggagtcgttagtatttagttagttgttaacgtctaagttactaacctaacgtgtacgtaacgttacgggttcgggtacgtccggggacggacggtacgacggtcgttaaccggccgttaccgtaggtccaccgggacccgaacggtcccgcccgtccccgtcggtacctccgttcgtcccgtccccgaccgtaccg

SEQ ID NO: 274383 - DNA, 732 bp, Homo sapiens
  misc_feature: GYAE6OF01A59GF.27.23.C01.1.454.CMB.1.raw
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcacgtcggaaccccgcgatggacgtttggtgtctttaattaactttatcttggttcggtaccgacaggacccaggccactcgtaccccaaatcctatttctttatgtatgtactaagtaactccgggtaccccgtaggggtttctgtacgttcgtcttctagtcggtcctacctaagtctcgaccctacaccggtccctcccgtagaccctacgtccgtcccgggtccttaccgacggtccgtaggacgggacggtacgtacgttacgtaactttatttacgtttggttacgttacgtaaattaaccgtaacctaaaccgtagtacgtaaaccgttagggtttacggggtacggttaccggggacgggtaacgggtacccgtacggggtccttaccgggttacccggttaccggttaacgggtaccgaaccggtacccgaacggtcccgttccccggacccccgttacggtacccgttacccttccgtttcccggttcccccgtcccgttaccccg

SEQ ID NO: 274384 - DNA, 678 bp, Homo sapiens
  misc_feature: GYAE6OF01CXRHB.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtgtctgggtcctcctggacagtcgatcaccatctcctgcactcggaacccncgatggacgtttggtgtcttattaactttatctggttacggtaccgacacggacccaggcactcgtaccccaactctatttctttatgatgtacagtaactccggccccgtaggggtttcctagactcgtcttacgtagtcggtcctaccgtaagtcctcgtaccctaccgtacccggtccctccctacgaaccctcgttcccgtaccgggtctacccgagtccctaggacggacggtagacgttacgtaatttagttatgttaattcgaattaactaacaacctagtcgtaaccgtacggttagggttcgggttcgggagggtaccggacgacggtccgtacggtacccgtaccggttagggtaccctacgggacccgtaacggtcccgtccgtacccccgtacggtaccctaccgttcccgtacccgttcccccgcccgttacccg

SEQ ID NO: 274385 - DNA, 740 bp, Homo sapiens
  misc_feature: GYAE6OF01B5YYU.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctctgcactcggacccgnatgacgttggtntcttattaactttntcttgtcgtaccgacgacggaccaggcacgtccgtacccctaactctattttctttagtgtatcgtacgtaagttaaccgtccgggtaccccggtaggggtttcctggtacgttccgtctttacgtacgtcggtccttaccgtaacgtccgtcgaccctaccggacccggtccccgtcccgtcgtaaccctcgttcccggtaccgggcctacccgacggtccgtagggacgggaccggtaggtacttagtaactttagttagttacgttacgttaacgtacttaacgtaacctaccgtagtacgtaacgttcgggtttcgggttacgggttaccggggaacgggtaccgggtaacggtacggtccgttaccggtaccgtaccggttacgggtaccgtaacggtacccgaacgggtccctccccggtcccccgttacgggttaccctacccggttcccgttcccggttcccccgtcccgttacccg

SEQ ID NO: 274386 - DNA, 738 bp, Homo sapiens
  misc_feature: GYAE6OF01EOAQS.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgccctcgtgtctgggtctcctggacagtcgatcaccatctcctgcactggaacccgngatgacgttggngtcttaattaactttatcgttgttcggtaccgacacggaccaggcactcgtaccccaaactctaatttctttatcgtattcgtacacgtaactccgggtaccccgtaggggtttctagtacttcgtcttctagtcggacctaccgtaagtcctacgtaccctaaccgacccggtcccttcccgtacgacctacgttccgtcccgggtcctacccgacgtccgtaggaacgggtaccgaggtactagttatttactttagtttacggttattactaacttaactaaccgaaaccgtaggtacgtaaccgttaggtttcggggttacgggttacggggaccgggtaacgggacccgtagggtccgttacccggtaaccgttaccgtaggttcccgaaaccggtaccccgaacgggtccccgttccccggtcccccgttaaccggttaccctacccggttcccgtttacccggttccccccggtcccttaacccccggg

SEQ ID NO: 274387 - DNA, 704 bp, Homo sapiens
  misc_feature: GYAE6OF01ATXQ0.27.23.C01.1.454.CMB.1.raw
  modified_base (232)..(232): a, c, t, g, unknown or other
  misc_feature (232)..(232): n is a, c, g, or t
  modified_base (261)..(261): a, c, t, g, unknown or other
  misc_feature (261)..(261): n is a, c, g, or t
  modified_base (321)..(321): a, c, t, g, unknown or other
  misc_feature (321)..(321): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtcggaacccgngatggacgtttggtgctttaataactttntcttgttcggtaccgacgacggacccaggccacttcgtacccccaaatccatttctttangtatgtcagtaactcccggcccctagttcgggtttactgtacttccgtctttcgtagttcggccttaccgtaacgttctcgtacccgtaccgacccggtccctacccgtcgaccctacgttcccggtccccgggtcctcccgacgccgtaggacggacggacggtcttagtaactttatttagttgttacgttactaacttaactaacctaacgtagttacgtaacgttacggtttaggggtcggttacgggaccgggagggtaccctgggtctccggtaaccgttaccggtaacggtccgaaccgggtacccgaacggtcccgtccggtaccccccgttcggtacccttacccgttccgttccccggttccccctaaccccg

SEQ ID NO: 274388 - DNA, 647 bp, Homo sapiens
  misc_feature: GYAE6OF01BMQAT.27.23.C01.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttgnctttataactttntctgtggtaccgacacggaccaggcactcgtacccaactctatttcttatgatgtcagtaacgtccggccccgtagggtttctgactcgtcttactagtcggcctcaagtctcgcctacgaccggtccctccctgaccgtactccgtccgggcctcccgaacgtccgtacggacgggacgacggtacctgtaactttagttagtttagttaagttacgtaattaactaaccgtaacctagttacgtaacgtacggtttagggtacggttccgggacgggacgggaccgacgggtacgtcggtaccggttccgtaggtccgacggtcccgaacggtccgtacccgtcccccgttacggtcctaccgttcccgttccggttcccctcccgttcccg

SEQ ID NO: 274389 - DNA, 722 bp, Homo sapiens
  misc_feature: GYAE6OF01CP6RW.27.23.C01.1.454.CMB.1.raw
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcagggcacgacgggtcctcgggcccacgctttttttttcgccctcgactcacgcctcgcctccgtgtcgtgggtctccgtggacagtcgactcacactctcctcgcacgacggaaccgcgatgtacgttggtgtacttaattaactttattcgttagttacggtaccgacgacggaccgacggacactactaccctaaactctaactttcgtttaatgtacgttagtctaaaggtaacgtccggtaccccggtagggtttcgtagtactcgtcttntagtcgacctacgtaatcncgtacctaccacgtccctacccacgactactccgtaccggcctacacgccgtggacggacgacgtatagtaacttttaggttaattacggttaactacgtaactttaactaaaccgaaacgtaaggttactaacggttaacgtttcgggggtaacggttccgggaaaggggaccggtaaccgtaggaaccgtcggtaaaccccggtcgtaacgggtacccgacggtacccgtaacgggtcccgtaccgtcccccgttaggtaccctacggttccctacccgttcccggccctaccg

SEQ ID NO: 274390 - DNA, 727 bp, Homo sapiens
  misc_feature: GYAE6OF01D117Q.27.23.C01.1.454.CMB.1.raw
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
  modified_base (365)..(365): a, c, t, g, unknown or other
  misc_feature (365)..(365): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgccactcggaacccgngatgacgttggtgtcttaataactttntcttggttcggtaccgacgacggacccaggcactccgtaccccaaactctatttctttatgtagttgtacgtaagttaacgtccgggtcccccgttaggggtttcngtactcgtcttctagtcgcctacagtcgtcgcctacgccgtccctaccgcaccgtacgtccgtcccgggactaccgacgtccgtaggacgggacggtacgtcgttagttagtttatttagttagtttaacgttactacttaacgtaaccaacgtagtacggtaaccgttacggtttaggggttacgggttaccggggacgggtaacggggtacccgtacgggtccgtacccggtacccggttaccggtaacgggttacccgaacgggtaacccccggaggttcccccgtacccgggtaccccccttaccgggttaccctaccggtttccccgtttccccggttcccccgtccccgttcccgg

SEQ ID NO: 274391 - DNA, 602 bp, Homo sapiens
  misc_feature: GYAE6OF01EC3SU.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (410)..(410): a, c, t, g, unknown or other
  misc_feature (410)..(410): n is a, c, g, or t
  modified_base (471)..(471): a, c, t, g, unknown or other
  misc_feature (471)..(471): n is a, c, g, or t
  modified_base (486)..(486): a, c, t, g, unknown or other
  misc_feature (486)..(486): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaacccngatgacgttggngactttaataactttatctgttggtaccgacacggacccaggcactcgtaccccaaactctattctttatgtatgtacaagttaacgtccgggaccccgtaggggtttctagactccgtcttactagtcggcctaccgaagtctcgcctaacgacggtccctcccgtanaaccctacgtccgtccgggtctaccgacgcctaggagacgagctagtattattattgtatntatacaacaactagntaacgtacgttgggtcgttcgggacggagaccgaggcgtacggaccgttccgtagtcgacgacccgaacgggcctccgccccgtcgtaccacctcgttccgtccccgtccgtaccg

SEQ ID NO: 274392 - DNA, 751 bp, Homo sapiens
  misc_feature: GYAE6OF01AZ025.27.23.C01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtacacgtgattagggattgggaggggtctcaggaggcagcgctctcgggacgtctccaccatggcctgggctctgctattcctcaccctcctcactcagggcacgagggtcctgggcccagtctgccctgactcagcctgcctcgtgtctgggtcctccgtggacagtcgatccaccatctcctgcacgtcggaacccgngattggtacgttggtgtactttaattaactttatcgtaggttacggtaccgactaaccggaccaggcctactccgtaccccaaatctatttcctttatgtatgtactagtaacgtcccggacccgtagggtttctagtacttcgtctttcgacgtggaccctacgaacgtcctcgtaccctacgtacccgtccctacccgtgaacccctacgtcccgtccgggtacctacccgtaccggtcccgtaggaaccgggtacgaacggtcttaacggttaattttagttaacggtttagtaacgtttactaacttaacgtaactaaaccgtggtaaccgtaacgttcgggtttagggggtcggttacccggggacgggtaccgggaacccgttcggggtaccgtaacgggtaccccgttacggtacggtacccgtaaccggaccccgggtaaggtccccctacccggtcccccggttagtacccctaccgtttacccggtcccccgttccccgtcccccg

SEQ ID NO: 274393 - DNA, 635 bp, Homo sapiens
  misc_feature: GYAE6OF01DOATL.27.23.C01.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (455)..(455): a, c, t, g, unknown or other
  misc_feature (455)..(455): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacagggtcctgggcccagtctgccctgactcagcctgccctccgtgtctgggtctcctggacngtcgatcacatcnctgcactggaacccngatgacgttggtncttatactttatctgttcgtaccgacacggacccaggccactcgtaccccaaactcatttctttangatgtcaagtacgtccggtcccctagggtttcngactcgtcttcatcggctcaagtcngcctacgccgcctcctnaccacgtccgtccgggctaccgagtcccgtaggaggtaccggagtcttacgtatttattagttagttacgttntactataaccgaacctagtacgaacgttacggtttgggtcggtttcgggacgggtacgggaccgtaggtaccgttccggtaccgttccgtacggtacccgacggtacccgaacgggtccctacccgccccggttaccgggtactacccgttaccttcccgtcccccgtcccttaccccgg

SEQ ID NO: 274394 - DNA, 776 bp, Homo sapiens
  misc_feature: GYAE6OF01DM5BQ.27.23.C01.1.454.CMB.1.raw
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgacacgtaccgaccgntatcgtaggtggtctacttaacttacttntcgttggtaccggtaccgagaacccggacggacgactacgtacccctaacctactctttactttacgttagagtacgttgtacgtaacgtaccggtccccggtaccgggtttagttcacgtcgtccgttattacgtagtccgtacctaacgtactcgtaccgtcccgtaaccggtcccgtcccctcgtaaccgtaccttccgttcccgggtcccgtcctaccgtaccggtccggtaagggaaccggaaccgggtacgttacgtagtttaaagtttacgtttaggttacgtttacgtaactaacgttaactaaaccgtacgtagtacgtaaccggtttaggggtttacgggttacggggtccggggtaacgggaccgtacggggaccgttccggtaacccggttaccgtacggtaccgacccggtaccggtaacccggtcggtcccggtaccccccgttccggtacccgttacccttaccgtttcccttacccccgtacccctccccgttaacg

SEQ ID NO: 274395 - DNA, 740 bp, Homo sapiens
  misc_feature: GYAE6OF01BG6JM.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgctttaataacttttatcttgttggtaccgacaggacccaggcactcgtaccccaaactctattctttatgtatgtcagtaactccggaccccgtaggggtttctgtactcgtacttctacgtcggtcctaccgtaagttcctcgtaccctaaccgacccggtcccttaccccgtagtaccctacgttcccgtcccgggtcctacccgacgtcccgtagggacgggtacggtacggtaccttaggtaatttaacgtttagttagttaacgttactaagttaactaaccgaaccgtagtacgaacgttacggtttcggggttacggttaccggggacgggacgggtaacccgtacgggtaccgttacggtacccggttaccggtaacgggttaccgaccggtaaccccgaacgggttccccttacccgggtaccccccccgttacgggttaccctacccggttacccttcccggttacccccctccccgtttaccccg

SEQ ID NO: 274396 - DNA, 680 bp, Homo sapiens
  misc_feature: GYAE6OF01CQ7LG.27.23.C01.1.454.CMB.1.raw
  modified_base (236)..(236): a, c, t, g, unknown or other
  misc_feature (236)..(236): n is a, c, g, or t
  modified_base (270)..(270): a, c, t, g, unknown or other
  misc_feature (270)..(270): n is a, c, g, or t
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgcacgtcgggaacccgngatcggtacgtttggtgtactttattaaactttntcgttggttacggtaaccgacgaacggacccgaggcctacgtccgtaacccctaactctatttctttatgtntgtacacgtacgtccggcccgtagggtttcngtatcgtcttntacgtcgctacgagtctcgtacctacgaccggtccctccgtacgacctacgtcccgtccggtcctaccgacgccgtaggacggtacggtacggtcttagttaatttagttagttcgttaattacattaactaaccaacgtagtacgtaccgttacggttggggtacggtcgggacgggtacggacgcggtaccgtaccggtaccggtacgtacggtacgaccggtaccgacggtcccgtacccgtccccgttcgtaccttaccttcccgttccccgttccccgtccccttacccgg

SEQ ID NO: 274397 - DNA, 863 bp, Homo sapiens
  misc_feature: GYAE6OF01CKVDW.27.23.C01.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (312)..(312): a, c, t, g, unknown or other
  misc_feature (312)..(312): n is a, c, g, or t
tcagagcgtcgtctcacgaccggtgctcgatttagtacacgtgattagggattgggggggggtctcaggaggcagcgctctcgggacgtctccaccatggcctggctctgctattcctcaccctcctcactcagggcacagggtcctgggcccagtctgccctgactcagcctgcctcgtgtctgggtctcctggacagtcgatcacatctcctgccacgtggaacccgngatggacgtttggntcttataactttatcttgttggtaccgacacggacccaggcactcgtaccccaactctatttctttangtattgtactagtaacgtcccggccccgtaggggtttcctagtactccgtctttctagtcggtacctcctaacgttctacgacccttaccgaccggtcccctacccgtacgaccctacgttcccggtacccgggtccttacccgacgtacccgtacgggaacgggtaccggtacggtaccgttaggttaaacgtttttacgttttagtttacggtttaacggtttaccttaaacgtttaaaccgttaaaccgtaaacccgtaagggtttaaccgggttaaaccgtttaaccgggttttcggggggtttacggggtttaccgggggacccgggggttaaccggggtaacccggtacggggtaccccggttaccggggttaaccccgttacccgggttaaaccggggttcccgaaacccggggttacccccgggaaaccggggttcccccgttaccccgggttacccccccccggtttacggggttaacccccttaccccggtttaccccgtttacccccgggtttacccccccttaacccccgttaccccgg

SEQ ID NO: 274398 - DNA, 716 bp, Homo sapiens
  misc_feature: GYAE6OF01ATJ50.27.23.C01.1.454.CMB.1.raw
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttntctgttggtaccgacacggacccaggcactcgtaccccaaactcatttctttatgatgtcagttaacgtccggtacccccgtaggggttttcctagtacttccggtcctttcttacgtcggccttcccgtaaagttcctacgacccctacgacccggtccccttcccgtacggaaccctacgttccgtcccggggaccttacccgacgtccctagggaacgggacgacgggtctagttaattttactttagtttggtttacgttacctaattaactaacctaaccctaggtagtaaccgtaacggtttcgggtacggtttaccggggcgggtaacggggacccgtagggtccgtacggacccggttccgtaacgggtccgtaccggacccgtaacggtcccttccccggtcccccgttccggtacctacccgttcctcccgttccccctccccgttcccg

SEQ ID NO: 274399 - DNA, 768 bp, Homo sapiens
  misc_feature: GYAE6OF01CPE9T.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgngatggtacgttggtgctttaattaacctttatcttggttacggtaccgacacggacccaggcactacgtaccccaaactcatttctttatgatgtctaatacgtccggccccgtaggggtttctagagtcgtcttactatggtcctaccaagtctcgcctaacgccggtcctcccgtagaccctactcccggtccgggtcctccgacggtccgtaggaacgggacggtacggtacgtagttaacgtttaagtttacgtttaggtttaacgtttacaatttaaccttaacgtaaacccgtaggttaacgaaaccttccgggtttaggggggtttacccggttacggggaccggggttaaacgggacccggtacgggtacccgttaccgggaccccggtttaccggttaaccggggtaccgtaaccccgggtaccccggtaaaacccgggggtcccttacccgggtccccccccgtttacggtacccctacccggtttcccgttccccgtttaccccccgtaaccccttcccccggg

SEQ ID NO: 274400 - DNA, 832 bp, Homo sapiens
  misc_feature: GYAE6OF01DQBNG.27.23.C01.1.454.CMB.1.raw
  modified_base (181)..(181): a, c, t, g, unknown or other
  misc_feature (181)..(181): n is a, c, g, or t
  modified_base (227)..(227): a, c, t, g, unknown or other
  misc_feature (227)..(227): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtntctgggtctctggacagtcgatcacatctcctgcactcggaacccncgatgacggttggtgtacctttaataactttatcttggttaggtaccgtaacgacggacccgaggccacgtccgtacccctaaactcctatttctttactgtattgtacgagttaacgtccggccccgttagggtttacgtagacttccgtcttctattcggaccttactaacgtcgtacgtccctaaccgaccggtccctccctacggaaccctacgttcccgtcccgggtacctaccggtaccgtacccggttacgggaacggggtaaccggtaacgggtccgttaaggtttaaacctttttacgttttaagtttacggttttacggtttaactaaacgttttaaccgtaaacccgttaaccggtaaacggttacggttaaaccgtttcggggtttacgggggtttaccggggtttaccggggacccgggggtacgggttaaccgaccggggtacgtacccggttacccgggttaacccgttacgggacccgtaacccggaacccggttaccgggtcccggttacccccgtcccccgggttacccgggttacccctaacccggttttccccgtaccgtttcccccccgtccccgttaacccgg

SEQ ID NO: 274401 - DNA, 875 bp, Homo sapiens
  misc_feature: GYAE6OF01A37CZ.27.23.C01.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaacccngatgacgttggtgctttataactttntctgttcggtaccgacaggacccaggcactcgtaccccaaactctatttctttatgtatgtacagtaacgtccggtccccgtaggggtttcctggtactcggtcctttactacgtcggtaccttccgtaaacgttccgttcggaccccttaaccgacccgggtccccttacccccgtacggtaacccctaacgttcccggtttccccgggggtacccttccccgtaacgggtccccgttacggggtaaaccggggtaaccgggtaacgggtaccgtttacgggttaaactttttaagttttaacgttttaggtttaaggtttacccttaaagttaaccttaaacccgaaaacccgttaacgggttacgtaaacccggttaaccgggttttcgggggtttacggggtttacccggggtacggggtaacggggtaacccgtacggggtaccgttaccgggtaaaccccgggtttcccgtaaacggggttacccgtaaccgggtacccccggttaaacggggtcccccgttaacccggtacccccccccgtttcggggttaaccccttacccgtttccccggtttaccccggtttccccccgggttccccccgtttacccccgg

SEQ ID NO: 274402 - DNA, 762 bp, Homo sapiens
  misc_feature: GYAE6OF01AQLC7.27.23.C01.1.454.CMB.1.raw
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactcggaacccgcgatgacgtttggtgactttataacttttatcttgttcggtaccgacacggacccaggcacgtcgtaccccaaactcatttctttangatgtctagtaagtccggtaccccgtagggtttcngtactcgtacttcgtagtcggcctaccaagttcctcgtacccgtaccgaccggtcccttccctcgaacctactcccgtacccgggtcctaccgtacgcccgtagacgggaaccgtacggtcttacgtaattttacgttagtttacgtttaacggtttactaaacgtttaactaaccgtaacccgtaaggttacgtaaccgttaacggtttcgggggtttacgggtttaccggggacggggtaacggggtacccgtaggggtacccgtacgggtacccggttacccggttaaggtcccggtaaaccgggtaccccggtaaacggtcccgttccccgggtacccccctttaccggggttaccttaccccgtttcccggtttaccccggtttcccccggacccctttaccccgg

SEQ ID NO: 274403 - DNA, 807 bp, Homo sapiens
  misc_feature: GYAE6OF01BSYAG.27.23.C01.1.454.CMB.1.raw
  modified_base (221)..(221): a, c, t, g, unknown or other
  misc_feature (221)..(221): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctcgccctgactcagcctgccctcgtgtctgggtctccgtggacagtcgatcaccatcctcctnacacgtacggaacccgcgattcggtacggtttggtcgtactttaagttaacttttatcgttaggttacggtaacccgaacgaccgggacccacgggcctaaccgtccgtaaccccctaaacttcctaatttcctttagtcgtagttacgtacgtaacgttaaccggtcccgggtaccccggttaggggtttacctagtactccgtcttacgtagtcggtcctacctaaggtcctcgtacccctacggtacccggccccttaccgtaccgtacctacgtcccggtcccgggtcctacccgacgtacccgtagggacggtaccggaggtcttagttaactttagttacgttaggttaacttctaaatacctaaaccaacgtaaggttaccgtacggttacggtttacggggtcggttacggggaaccgggtacgggtaaccgtaccgggtcctaaccgggtacccgttaccggtaaaccgggtccgtaacccggtaaccccgggtacgtccccggttacccccgtacccccggttcgtacccgtaccggttacccctttccccgttacccccctacccgttaccccgg

SEQ ID NO: 274404 - DNA, 751 bp, Homo sapiens
  misc_feature: GYAE6OF01DEJ0B.27.23.C01.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
tcagagcgtcgtctcacgaccggtgctcgatttagtacacgtgattagggattggggggggtcgtcaggaggcagcgctctcgggacgtctccaccatggcctgggctctgctattccctcaccctcctcactcagggcacgagggtcctgggcccagtctgccctgactcagcctgcctccgtgtctgggtctccgtggacngtcgatcaccntctcctgcctacgtacggaacccngatggtacgttggtntacgtttaattactttatcttggttacggtaccganacggacccaggccacgtcgtacccaactctatttctttatgatgtactaacgtaacgtccggacccccgttaggggtttctacgtagtccgtctttctacgttcggtccctaccgtaacgttccgtaccgccctaaccgaccggtcccccttccgtacgaccctacgttccggtcccgggcctaccgaccgtcccgtagggaacgggtaccggacgtcgttacgttaatttacgtttattaggttacgttacaagttaacctaacgaacctaggtactaaccttagggtttgggtacgggttcgggacggggtaacgggtaccgtgggtacctccgggtaacccgttaccgggtggacccgtaaggacccccggtaaggtcccgttaccccccggtcccccgttacccgggttcccacccgtttcccggtttcccggttcccccccgtccctttacccccgg

SEQ ID NO: 274405 - DNA, 750 bp, Homo sapiens
  misc_feature: GYAE6OF01C13QE.27.23.C01.1.454.CMB.1.raw
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatcgacgttggtgactttataactttatcttgttcggtaccgacgacggacccaggcactcgtaccccaaatctattctttangtatgactagtaacgtcccggccccgttagggtttctgtactcgtcttctagtcggcctaccgtaagttcctacgtacccgtaccgaccggtccccttacccgtcgaccctacgttcccgtcccgggtccttaccgacgtcccgtagggacgggtacggacggtcgttagttaactttagtttagtttagttacgttactaacttaactaaccgtaaacccgtaggttacgaaccgttaccgggtttgggggtttccggttaccgggggacggggtaaccgggtaccggtacgggtaccgttaccgggtaccccggttaccgggttaacggtaaccggaacccggtaccccggaaacggttccccggtccccgtacccccggttccgggtccttacccgttcccgtttcccggttccccccggccccgttaacccg

SEQ ID NO: 274406 - DNA, 679 bp, Homo sapiens
  misc_feature: GYAE6OF01B02G6.27.23.C01.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (351)..(351): a, c, t, g, unknown or other
  misc_feature (351)..(351): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacagtcgatcaccatctcctgccacgtcggaacccgngatgacgttggtnctttataacttntcttgtcgtaccacagaccagcactcgtaccccaaactctatttctttatgtatgtctaagtaacgtcccggtaccccgtaggggttttccnggtacttcgtcctttacgtacgtcggtacctacgtaaacgttcctcgaccctacgtaccggtaccctcccgtacgtaccctacgtcccgtccgggcctaccgacgtccgacggacggacgtacgtctacgtaatttattagttgttacgttacattaactactaactagtacgtacgtacgtttcgggtagtaccgggacgggaacggtccgtaggtccgtacgtacccgttaccgttaggaccgaaccgacccggaacggtcccgtacccgtcccccggtacggtaccctaccgttcccgttcccgttcccccgtccccttacccgg

SEQ ID NO: 274407 - DNA, 769 bp, Homo sapiens
  misc_feature: GYAE6OF01D080M.27.23.C01.1.454.CMB.1.raw
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (759)..(759): a, c, t, g, unknown or other
  misc_feature (759)..(759): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcgagggcacgagggtcctgggcccagtctgccctgactcagcctgcctcgtgtcgtgggtctccgtggacagtcgatccacntcctctgcacgtggaacccngtagtgacgttggntactttattaacttntcttggttacggtaaccggacgacggacccaggcctacgtacccgtacccctaaacttcttaacttttacttttagacggttattcggttaccgtaacggtttaaccgtccccggggtaccccggtttaggggttttccacggttacgttccgtctttacgtaaggtccggtcctaaccggtaacgttccgcgtaccccgtaccgtaccggtcccctaccgtccaacctcgtccggtcccggtactccgtacggtaccgtagggaacgggacgtacggttcttaggtttaactttagtttacgttaggttaaccttctaactaacgtaaccctaagtacggttcgtaaacggttcgggttcgggtaccgggttcgggcggaaacgggtccgtaggtacccgtcggtaccgttacgtacccggttacgaccccggaacgttccggcttcccccggtacccgttcgtacccttccgtttacccgtccccgttccccncccttaccgg

SEQ ID NO: 274408 - DNA, 788 bp, Homo sapiens
  misc_feature: GYAE6OF01AHGCV.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgctacgtcgggaaccccgcgaatcggtacggtttggtgtacctttaattaaccttttatcgttggtttcgggttaaccgacgacgggacccaagggccaccgtcgtaccccctaaactcctatttccttttaagtcgtattgtaccgtagttaaaccgtcccgggtacccccgttaggggttttcctacggtaacgtccggttacctttacgttacgtcgggtcccttaccgaaacgttccgtcgtaccctaccgaccggtccctacccgtacgtaacccctcgtacccgtcccgggcttcccgacgtccccgtgggaacggacggtacggtcgttagtaacgttttagttactttacggttagtttaccgtaattactaaaccgaaccgtggtacgtaaccgtaccggtttggggttcgttaccggggtcgggtacgggtaaccgtacgggtccttacgggtacccgtccggtaaggtcccgaacggtacccccggaagggtccctacccggtccccccgttacggtaccctaccgttcccggttccccgttccccggtccccttaaccg

SEQ ID NO: 274409 - DNA, 710 bp, Homo sapiens
  misc_feature: GYAE6OF01ENRGA.27.23.C01.1.454.CMB.1.raw
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgctttaataactttntctgttggtaccgacacggacccaggcactcgtaccccaaactctaatttctttatgtatcgtacagtaactccggccccgtaggggtttctgacttcgcttctagtcggctaccaagtctcgcctaccgaccggtccctcccgtacgacctacgttccgtcccgggtctacccgacgtcccgtaggaacggacggacggtcgtaggttaactttaatttacgtttagttacgttactaattaactaaacaaaacgtaggttacgaaccgttacggtttggggttcggttaccgggacgggtaacgggtaccgacgggtcccgttacgggtacccggttccgttaacgggtccgtaaccgggtaccccgaaacgggtcccgttacccggtccccccgttacgggttaccctacccgttcccgtttccggttacccccctaccccgttccccg

SEQ ID NO: 274410 - DNA, 698 bp, Homo sapiens
  misc_feature: GYAE6OF01CXEDQ.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcacgtcggaacccngatgacgttggtnactttattaactttntcttgttacgtaccgagacggaccagcactcgtaccccaatctattcttangntgtacaagtacgtccggcccgtagggtttcagtactcgtacttgtacgtcggtcctacgtaacggtctacgtacccgtaccgtaccggtccctacccttacgaccctacgttcccgacggtcctaccgacgtcgtacggacgggacgtacggtaccttagtaactttatttacgttacgttaacttacgaacttaacctaacgtaacgtacgtacggttaaccgttaacgggtttcggggttcgtaccgggaacggggtacggaaccggtagggtccgttaccggtaccgttccgtaacggtacgacccgtaacccgaccgggtcctaccccggtaccccggttcgtaccctacgtacccgtttccctacccccgtcccgtacccg

SEQ ID NO: 274411 - DNA, 823 bp, Homo sapiens
  misc_feature: GYAE6OF01AJB25.27.23.C01.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
tcagagcgtcgtctcacgaccggtgctcgatttagtacacgtgattagggagttggggggggtcggtcgaggaggcgagcgctcgtcgggacgtctccaccatggcctggctctgctattcctcaccctcctcactcgagggcacgagggtccgtcgggcccaggtctcgccctgacctcgagcctcgcctccggtgtctcgggtctccgtggacngtcgactcaccgtactctccctgaccacgtcggaaaccccgngtagtcggacggtttggtcgtactttaacgtttaaaccttttnttccttggttttacggtaacccgaacgaccgggtaacccaggcctaccgttcgtacccccctaaatctacgttttacttttagtacgtagttcggtaacgtacggtaacgtcccgggtccccgtaggggtttcctagtaccgttgtccttacgtagttaccggccgttaccaagttcccgtagtacccgtaaccggccgtcccttccgtaacgaccctacggttcccgtccgggacctcgttacgcccgtgggaccggacgtaacgggcttagtaacgtttagttagtttacgttacgtaacgtaatttaaaccgaaccttaacgtaacgacgttaaccgttacggtttcggggttcggttaccgggtaccggggaacgtaccggtaacggtccgtaacggtaccccgttaccggtacggttacccggaccgttaccggaaccggttcccgaccccgggttcccccgttacgggtcccttacccgttacccggtttccccgtccccggttaaccctcccggg

SEQ ID NO: 274412 - DNA, 752 bp, Homo sapiens
  misc_feature: GYAE6OF01EWVU2.27.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctcctgcactcggaacccngatgacgttggtncttaataactttatctgttggtaccgacaggacccaggcactcgtaccccaaacttctatttctttatgtactgtactaagttaacgtccgggtacccccgtaagggggttttcctagtaacgttcgtctttacctagtcggccttaccgaaacgttcctacgccctaaccgaccggtaccccttccgtacgacctacgtccgtcccgggactccgacgtccgtggaggaccggtaggtcttacggtatttaacgtttaatttcggttaacgtttacgtaaattaactaaacctaacccgtagttacgtaaccgttacgggtttaggggttcgggtttaccgggacgggggtaacggtaacccgagggtccgtacggtaccccggtttccgtaacgggttacccgaaccgggtaaccccgtaacggggtcccttacccgggtcccccccgttaccgggttacccgtaaccgtttccccggttacccgttccccccctacccgtaccccccg

SEQ ID NO: 274413 - DNA, 695 bp, Homo sapiens
  misc_feature: GYAE6OF01CJR3O.27.23.C01.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (405)..(405): a, c, t, g, unknown or other
  misc_feature (405)..(405): n is a, c, g, or t
  modified_base (503)..(503): a, c, t, g, unknown or other
  misc_feature (503)..(503): n is a, c, g, or t
tcagagcgtcgtctcacgaccggtgctcgatttagtacacgtgattagggagttgggggggggtctcaggaggcagcgctcgtcgggacgtctccaccatggcctgggctctgctattcctcaccctcctcactcagggcacgacgggtcctgggcccagtctgccctgactcacgcctgcctccgtgtctgggtctccgtgacngtcatccaccntcctctgcacgtcggaaccgcgagtggtacggtttggtactactttaagttaacttttgtcgttagggtttacggtaaccgaacgtaaccggaacccgcgacctaccgtaccgtaaccccctaaacttcttacttttactttagtacgtatcgtacgtaagtaaccgtccggtacccggtagggtttcngtactcgtcttacgtacgtcgtactacgtagtcctcgccctacgaccgtcccgtactacgtacctcgtccgccggtactcgacgcgtaggacgtacgngtactagtatttagttagttacgttagtactaactacttaacgaactaggacttaacggtacgggttgggtaccggtacgggtaggaccggtaacggtcgtacggtccggtaccgttcgacggtacgacccgaccgacggcccttacccgcccggttacgtcctacgttccctccgttccccgtcctaccgg

SEQ ID NO: 274414 - DNA, 842 bp, Homo sapiens
  misc_feature: GYAE6OF01CD2GW.27.23.C01.1.454.CMB.1.raw
  modified_base (242)..(242): a, c, t, g, unknown or other
  misc_feature (242)..(242): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgactcaccatcctcctgaccacgtacgggaacccgngtaagtggtaccggtttgggtctactttaattaaacctttgtcgtttggttaccggtaaccgacgacggaacccgacggtacctaccgttaccgtaccccctaaaacttcttaacttttacttttagtacgttagtcgttaactaacggttaaccgtcccgggtcccccggttaaggggttttcctacgtaccgttcgtacctttcgtagtcggtcctaaccgtaacgtcctccgtaacccgtaccgtaccggtcccctaccgtacgaccctacgtcccgttcccgggtcctacccggtacgtaccggtacgggacgggacgggtacggtccttaagttaactttttaagttcgtttagtaaccgtttataacggttaactaaaccgtaacgttaggtacgtacgttacggggtttacgggtacggggttaccgggaccgggtaacgggtcccggtacgggtaccggttacccgggtaacccggttccggtaaccggtacccgaaccggacccggtaccggtcccggtaccccccgtacccgggtcccggttacccttacccgtttcccttaccccggttccccctaacccgtaccccgg

SEQ ID NO: 274415 - DNA, 690 bp, Homo sapiens
  misc_feature: GYAE6OF01CYQHY.27.23.C01.1.454.CMB.1.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacngtcgatccaccatctcctgcacgtcggaacccgngatggtacgttgggtgactttaattaactttatcttaggttacggtaacccgacgacggacccgtaaggccacgtccgtacccctaaactctatttccgtttatgtattcgtacagtaacgtccggtaccccgtaggggtttctgtactcgtcttactagtcggtactaccgtaagttcctccgtacccgttaccgacccggtcccctcccgtagaccctacgtcccggtacccgggcttaccgacgccgtaggacggacgacggtctagtattattagttagttagtactattaactaacaactaggtactaacgtacggtttgggtacggtcgggacgggacggtaccgtggtaccgtacggtaccgtcgtacggtacgaaccggtccgaacggtccgtcccgtaccccgtacggtccctaccgttccgttccccgttccccgtccctacccgg

SEQ ID NO: 274416 - DNA, 813 bp, Homo sapiens
  misc_feature: GYAE6OF01D40F0.27.23.C01.1.454.CMB.1.raw
  modified_base (257)..(257): a, c, t, g, unknown or other
  misc_feature (257)..(257): n is a, c, g, or t
tcagagcgtcgtctcacgaccggtgctcgatttagtacacgtgattagggagttggggggggtctctaggaggcagcgctctcgggacgtctccaccatcggcctggctcgtgctattcctcaccctcctctactcagggccacgagggtcctcgggcccagtcctcgccctgacctcacgcctcgtcctcgtagtcgtcgggtcctccgtggactcgtcgactccacctactcctccgtgcctacgtcggaacccngtactcggtacggttcggtcttactttaacttaactttctcgttcggttacggtaccgacgtacggaccgacggctactaccgtaaccctaactctactttacttacgtcgtatcgtacgtaacgtccgtcccgggtacccggttaggttctacggtactccggtctcgtcgtcgacctcgtacgtctacgtacctaccgccgtcctccgcctacgtacgtccggtccggtctaccgtcgtacgtacggacggtacgtacggtattacggttacgtttacttacgtttacgtacttacgtaactaaccgtacgtaacgttacggtaccgtacggtttaaccggggtttcgggttccggggtaaccgggtacggggtaaccggtaccgggtaccggttaccggtaccggttaaccgggttaccgtacgggtaacccgggtaaccctaccggggtaacccggttcccggtaaccccccgggttcccggttaccccggttaacccgttaacccggtttccccggtttaccccccgttccccgtaccccttaacccgggg

SEQ ID NO: 274417 - DNA, 782 bp, Homo sapiens
  misc_feature: GYAE6OF01BELSP.27.23.C01.1.454.CMB.1.raw
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatcctcctgcactggaacccgcgatgacgttggtgtactttaataactttatcgttgttcggtaccgacacggaccaggcactcgtaccccaaattctatttctttaatcgtattcgtactaaggtaactcccgggtacccccggttaggggttttcacgtacgttccgtcttttacgtagttccggtaccttacccgtaaaggttccgtacgtacccgttaacccgaccggttccccttacccgtaccgtaacccgtaaccgttcccggtcccggggtaccctacccgtaccggtcccggtaggaaaccggggtaaccggtacggtaccgttaaggttaaacttttaaggtttacgtttaggtttaacgtttaccctaaagtttaaccaaaccgtaacccgttaggttacgtaccggtttaaccggttggggtacggttcggggacgggacggtacccggtagtccgtacggtacccgttcgtaacggtcgaaccggtacccgaaggtcccgtacccgtacccccgggttctacccgtaccgttcccgtcccggttccccgtcccgttacccg

SEQ ID NO: 274418 - DNA, 714 bp, Homo sapiens
  misc_feature: GYAE6OF01A9399.27.23.C01.1.454.CMB.1.raw
  modified_base (230)..(230): a, c, t, g, unknown or other
  misc_feature (230)..(230): n is a, c, g, or t
  modified_base (384)..(384): a, c, t, g, unknown or other
  misc_feature (384)..(384): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgtcttattaactttatcttgttacggtaccgacgacgaccaggcactacgaccccaaactctatttcttatgatcgtcaagtactccggccccgtagggtttctcggtactcgtacttctagtcggtacctccgaagttccncgtaccccgtaacaccggtccccttaccgtcgtaccctaacgtccggttcccggccttccgacgtaccgtaggaacggacgtcggtcttagttaacgtttaatttagtttacggttaacgtttactaattaacctaacctaacgtaggttacgtaacgttacgttacgggggttacgttaccggggaccgggaacgggtaccggtaggtccgttacggtaacccggttcccgtaagggttacccggaccgtacccgaaggttccccgtcccggtacccccctccgggttaacaccccgtttcgttccccggttccccgtcccttccccgg

SEQ ID NO: 274419 - DNA, 869 bp, Homo sapiens
  misc_feature: GYAE6OF01EM1LY.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgtctttaataacttttatcttgttcggtaccgacacggacccaggcactcgtaccccaaactctatttctttatgtatgtacagtaacgtccggaccccgtaggggtttctgtactcgtctttcgtagtcggtcctaccgtaagttccgtacgtaccccgttaaccgacccggtccccttccccgtacgtaaccccgtaacgttccccggttaccccggggtacccttaccccggaaccggttccccgttacggggaacggggtaacccgggtaacgggtacccgtttagggttaaactttttaaacgttttaacggttttacggttttaacggtttaaccctaaacgttttaaaccgttaaaccccgtaaaacccggttaggtttaaccgtaaccgtttaaccggggttttcggggtttacggggtttacccgggggaccgggggtaaccggggtaacccggtaggggtacccgttaccgggtaaccccggttaccggttaacgggttaacccgaccgggtaaccccgggtaacgggttccccgttacccccgggtccccccgtttaccgggtacccttacccggtttccccgttccccgtttaccccccgtcccccgttaccccgg

SEQ ID NO: 274420 - DNA, 652 bp, Homo sapiens
  misc_feature: GYAE6OF01AZVUF.27.23.C01.1.454.CMB.1.raw
  modified_base (348)..(348): a, c, t, g, unknown or other
  misc_feature (348)..(348): n is a, c, g, or t
  modified_base (396)..(396): a, c, t, g, unknown or other
  misc_feature (396)..(396): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttaataacttttatctgttggtaccgacacggacccaggcactcgtaccccaactctatttctttatgtatgtacagtaacgtccggtccccgtagggtttcngtatcgtcttctatggctacgtagtctacgcctacaccggccctccgngacctctcgtccggctccgagcccgtaggacggacgacgtctagtatttattacgttgttacgttacaacttactaaccgtaactagttacgaacttacgggtttagggtcggttaccgggtacgggacggggtaccacgggtccgtacggtacccgttccgtacgggtacctaccggacccggtaacggtccctcccggtcccccgttcggttaccctaccgttaccgttcccggttcccccgcccgttaccccg

SEQ ID NO: 274421 - DNA, 736 bp, Homo sapiens
  misc_feature: GYAE6OF01D7JXD.27.23.C01.1.454.CMB.1.raw
  modified_base (237)..(237): a, c, t, g, unknown or other
  misc_feature (237)..(237): n is a, c, g, or t
  modified_base (443)..(443): a, c, t, g, unknown or other
  misc_feature (443)..(443): n is a, c, g, or t
  modified_base (728)..(728): a, c, t, g, unknown or other
  misc_feature (728)..(728): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatcaccatctcctgcacgtcggaacccgngatgtacgttggtgtactttaattaactttatcgttaggttacggtaacccgaacgacggacccaggacctaccgttaccgtaaccccctaaaattcttaacttttaccgtttaatgtaacttcggtactaaggttaaccgtccccgggtaccccggttagggtttccaggtacttcgtacttcgtacgtcggtacctacgagtcncgtaccgtacgaccgtcctaccgagtaacctcgtccggtccggacctaccgcgtccgtagggacggtacgtaggtacttaggttaactttagtttagttacgttagttaactattaaaccgtaacctaacgaggttacgaacgtttcgggttacggggttcggtaccgggacgggtaacggacgtacgggtcctacgggtacccgtcggtaaccgggacgaccggaccgacggtccccgttacccgcccccgttggtaccttcccgttccttcccccgttccccncgtaaccg

SEQ ID NO: 274422 - DNA, 813 bp, Homo sapiens
  misc_feature: GYAE6OF01EXKNB.27.23.C01.1.454.CMB.1.raw
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcgatcaccatctcctgcacgtcggaacccgngtatggacgttggtcgtactttaattaaacttttntcgttggttacggtaaccgacgacggacccgtaggcactcgtacccccaaatctaatttctttatgtagttcgtacgtaacggttaacgtccccgggtaccccggttaggggttttcctacgtacgttccggtcctttacgttacggttccggtcccttacccgtaaaggttccctacggtaccccttaaccgcccggttaccccttccccgtacgacccgtacgttcccggtcccgggtcctacccgtaccggtcccgtagggaaccggtacgggtacggtacttacgtttaatttaagttttacgttacggtttaacgtttactaaacgttaacccttaaacccgtaaccgtaggtacgtaaccgtttacgggtttcgggggttacggttaccgggggaccgggtaacggggaccacggggttaccctacgggtaaccccggtttccgggtaaccgtccgaacccggtcccggaaccggtcccggttcccgcccccggttcgtacccgtccctttaccggttccccgttcccccgccccgttacgg

SEQ ID NO: 274423 - DNA, 937 bp, Homo sapiens
  misc_feature: GYAE6OF01A60R4.27.23.C01.1.454.CMB.1.raw
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtcctgccctgactcagcctgcctccgtgtctgggtcctcctggacagtcgatccaccatcctcctgccacgtcggaaccccgngatggtacgttggtnctttaattaactttntcttgttggtaccgacgacggacccgaggccactcgtaccccaaactctatttacctttatgtatgtactaagttaacgtccggtaccccgtaggggtttttcgattccgtactttctacgtcggtacctacgaacgttcgtacgtacccgtaacgtacccgggtccccttaccccgtacggaaccccgtacgtttaccccgggttcccgggtaccccgttacccgtaccggtccccggttaacggggtaaccggggtaaaccccgggtaccgggtaaccccggtttaaggtttaaacccttttaaggttttttaacggttttacgggtttaacggttttaccgttaaatttaaacccgttaaacccgtaaacccggtaaggttaaccggtttaaccggttaaccgggttttacgggggtttaccggggtttaccgggggtaaaccggggggtaaccggggtaaccccggtaacgggttacccggtaaccgggttacccggttacccggttaaacggggttacccggtaaacccggtaccccgggtaaaaccgggttcccccgtttccccggggtacccccccgtttccgggtttaccccttaacccgggttcccgtttaacccccgggtttcccccccggccccgttttaaccccggtaaccccgggg

SEQ ID NO: 274424 - DNA, 759 bp, Homo sapiens
  misc_feature: GYAE6OF01D3AN0.27.23.C01.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (321)..(321): a, c, t, g, unknown or other
  misc_feature (321)..(321): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatcctcngcacgtcggaacccgcgatcgtacgttggtgtacttaacttaactttatcttggttcggtaccgacacggacccagcacgtcgtaccccaatctatttctttangtatgtactagtacgtcccggaccccgttagggtttctcgtactccgtcttctagtcgtacctaccgtagtcctcgtaccctaacgccggtccctcccgtaggtaaccctacttcccggtacccgggcccgtaccgacggtcccgtagggaacgggtacccggtaggtccgttagttaattttacgtttagttggttaaccttactaattaacctaacaaaccgttaggtacgtaacgttacgggtttcggggttacgggttccggggaaccggggacgggtaacccacggggtccgtaccgggtacccggttaccgttagggtacccggacccggtaccccggtaacgggttcccctaccccgggtcccccccgtttacgggttcccctaccccgtttcccggttaccccgggttcccccaccccgtttaccccggg

SEQ ID NO: 274425 - DNA, 741 bp, Homo sapiens
  misc_feature: GYAE6OF01DMGSM.27.23.C01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggacccncatgacgttggnctttaatactttntctgttcggtaccgacacggacccaggcactcgtacccaactctatttcgtttatgatcgtctaagtacgtacccggtcccgtagggtttctgactcgtctctagtcggtctcgaacgttcgtacgccgtacgacccggtccctccgtacgacccgtaacgttccgtacccgggtcctacccgtaccggtcccgttaagggacggtaaccggtaggtccgtaggttaacttttagtttaagtttgttaacgtttctaacttactaaccgaacgttagtcgtaaacgtcgggtttacgggttccgggttacgggtacggggtaacgggaccgtacgggtacgtcccggtaaccggttccggtaacggttaccgacccgggtaacccggtaaccggttacccggtccccggttaccccccgttacgggttacccctttaaccgtttaccccgtttccccggtttaacccccctccccccgttaacccgg

SEQ ID NO: 274426 - DNA, 756 bp, Homo sapiens
  misc_feature: GYAE6OF01BKRI4.27.23.C01.1.454.CMB.1.raw
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctcgccctgactcacgcctgcctccgtgtcgtgggtcctccgtggacagtcgatccaccatcctcctgcacgtcggaacccngtatggtacgttggtntactttaattaactttatcgttggttacggtaccgacgacggacccaggcctactccgtaccccaactctatttctttagtagtatcgtactaaggtaccgtccggtaccccgtagggtttctgtctcgtcttactgtcggctacgtagtccgtcgaccgtacgaccgtccctaccgtacgacctcgtcccggtccggtacctacccgtacggccgtaaggacgggtacgacggtacttaggttaatttagtttacgttaggttaacttacgtaacttaaccaaaccgtaacgtagtacgtacgttacgggtttcggggttacgggtaccgggtacggggtaaccggtaccgtacgggtaccgtccggtaacccggttccgtaacgggtacccgaccggtacccggaaccggttccccgtacccccgggttccccgtacccggttacccgttacccgtttaccccgtcccccgggttacccccgtccccgttaccccgg

SEQ ID NO: 274427 - DNA, 771 bp, Homo sapiens
  misc_feature: GYAE6OF01ERQOH.27.23.C01.1.454.CMB.1.raw
  modified_base (242)..(242): a, c, t, g, unknown or other
  misc_feature (242)..(242): n is a, c, g, or t
  modified_base (347)..(347): a, c, t, g, unknown or other
  misc_feature (347)..(347): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctcgccctgactcagcctcgcctccgtgtcgtcgggtctccgtggacagtcgatcaccatcctcctgctacgtcggaacccgngatgtacgttgtcgtactttaattaacttttatcgttaggttacggtaaccgacgacggaccaggcctaccgtaccgtaaccccaaattcttacttttacttagngtactcgtacgtaacgtaccgtcccggtacccgttagggtttcagtacttcgtcttacgacgtcggtcctacgtatcctcgtacccgtacgcccgtcctacccgtacgaacccgtcgttcccggtaccggtacctacccggacgttaccggagggaacgggacggtcggtactagtttatttagtttacgttcttaacgttacctaattaaccgtaaccgtaacggttacgaacggttacccgtttaggggtttcggggtacgggttaccgggaacggggtaccggtaccgtacggtacccgttaccgggtacccgttaccggaccgggtacgtaccccggaaccggtaccgtcccggttcccccgtaccccggttcgacctttaccccggttcccttcccccgttccccgtccccgtaaccgg

SEQ ID NO: 274428 - DNA, 678 bp, Homo sapiens
  misc_feature: GYAE6OF01CGIKJ.27.23.C01.1.454.CMB.1.raw
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (494)..(494): a, c, t, g, unknown or other
  misc_feature (494)..(494): n is a, c, g, or t
  modified_base (668)..(668): a, c, t, g, unknown or other
  misc_feature (668)..(668): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgccctccgtgtctgggtctcctggacagtcgatcacatctcctgcacgtcgggaacccgngactggtacggtttggtgactttaattaacttttatcgttgttacggtaccgacgaggaccgaggcctacctcgtaccccaatcctatttctttangtatntacgtaagtaccgtccggtaccccggttaaggggtttccaggtacttccggtcttacgttacgttcggtacctaccgtaacggttcctaccgacccttaaccggacccggtaccctaccccgtacgtaaacccgtcgttcccggacccgggtctacccgnggtacccgtacggacggacgtacggtctagtacttagttatgttactcaatacgaacacagtcgacgtaggttcggtacgggtcgacgggagacgacggctacggtacccgcggtagtccgacggacccgtaggccctcccgcccgttcggtaccacgttcctcccggtccccncccgttcccg

SEQ ID NO: 274429 - DNA, 702 bp, Homo sapiens
  misc_feature: GYAE6OF01ANVZR.27.23.C01.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcaggcacagggtcctgggcccagtctgccctgactcagcctgcctccgtgtctgggtctccgnggacagtcgatcacatctcctgcacgtggaacccngatcgacgtttggngtcttaataacttttntcttgttggtaccgacaggacccaggccactcgaccccaaactcattcgtttangatgtcagtacgtccggtaccccgtagggtttcngtactcgtcttcgtatcgtcctacctagtctcgaccctacgaccggtccctcccgtagaccctagttcccgtcccgggtcctcccgacggtcccgtacggaagggacccggaggtccttaggtaactttaagtttaactttacggttaacgttactaagtaccgttaaccaaccgtacgttacggtaaccttaacgggttggggttaccgttacggggaccgggtaacgggtacccagggtccgttcggtaacccggttccgtacggtaccgaccggtacccaacgggttcctaccccggtccccgtacgggtacctacccgttacccgtttccgtcccccgtccccttacccgg

SEQ ID NO: 274430 - DNA, 730 bp, Homo sapiens
  misc_feature: GYAE6OF01BWGHN.27.23.C01.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (312)..(312): a, c, t, g, unknown or other
  misc_feature (312)..(312): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
  modified_base (510)..(510): a, c, t, g, unknown or other
  misc_feature (510)..(510): n is a, c, g, or t
tcagagcgtcgtctcacgaccggtgctcgatttagtacacgtgattagggattggggggggtctcaggaggcgagcgctcgtcgggacgtctccaccatggcctggctctgctattcctcacccctcctcactcagggcacagggtcctgggcccagtctgccctgactcagcctgcctccgtgtctgggtctcctggacagtcatcaccntctctgcactcggaacccngatgacgttggtncttataactttntctgtggtaccgacacggaccngcactcgtaccccaaactctaatttcttatgtatntactagtaactcccgggtacccctaggggttttcacggtatccgttacttctagtcggaccttaccgaagttcctcgacccgttacgacccggtcccctacccgtccgtaaccctacgtcccggtcccgggtcctacccgtcgtcccgtagggaccggtaacggngtccgtagttaactttagttntttagttacgtntaacgtactaacaactagtacgtacgtacggtttagggtcggttacggggaccgggaacggtccggaacgggtccgttacgggtacccgttaccgggtacggtaccccgtaaacggtcccccggaaacggttcccccgtaacccgtccccccgggttacgggttacccttccccggttttcccgtaacccccggttccccccggtccccctttaacccgg

SEQ ID NO: 274431 - DNA, 735 bp, Homo sapiens
  misc_feature: GYAE6OF01B7YNE.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgngatggtacgttggtgactttaataactttatcttggttcggtaccgacgacggacccaggcactccgtaccccaactctatttctttatgtatcgtacgaagtaaccgtcccgggtaccccgttagggtttctgtactccgtacttctacgtcggtacctacgtaacgtctacgtaccctaaccgacccggtccctcccgtacgtaccctacgtcccggtcccggtacctacccgaacggtcccgtagggaacgggtaccgtacggtaccgttaggttaactttaagttttacgtttacggttacgttacctaacgttaactaacccgtaacgtacgtaacgtaccgttacggtttacggggtcggtttaccggggacgggttaccgggaccgtacggtcgtaccggaccgttcgtacggaccgtaccggacccgtacggtcctccccggtccccgttcggtacctaccgttcccttacccgttcccccgtccgtaccccg

SEQ ID NO: 274432 - DNA, 693 bp, Homo sapiens
  misc_feature: GYAE6OF01COC6Z.27.23.C01.1.454.CMB.1.raw
  modified_base (667)..(667): a, c, t, g, unknown or other
  misc_feature (667)..(667): n is a, c, g, or t
tcagagcgtcgtctcacgaccggtgctcgatttagtacacgtgattagggagttgggggggggtctcaggaggcagcgctctcgggacgtctccaccatggcctggctctgctattcctcaccctcctcactcagggcacagggtcctgggcccagtctcgccctgactcacgcctgccctccgtgtctgggtctccgtggacagtcactcaccatcctctggacctacgtaccgggaaccccgcgtagtcgtacggttgggtctactttattaacttttatcgttcggttacggtaccgacgaccggtacccaggacctacgtccgtaacccctaaactctactttactttacgtgtacttgtacgtaacgtaccgtcccggtccccggttagggttctcggtacttccgtacttcgtacgtcgtacctacgtacgtcctcgtacctaccgaccgtccctccgtacgcctacgtcccgtacggtccctaccgcgtaccgacggacgacgtagtactagttatttacgttagttacggttactacgtaacgtactaaccgaacgtacgtacgtacgtagttcgggtacggtcggacggacggcgtgtccgtacgtaccgtagtacgcgtaaccgaccgtacgtccgtaccccgtcccgtcggtaccncttccgtccccgtccctcccgtaccg

SEQ ID NO: 274433 - DNA, 755 bp, Homo sapiens
  misc_feature: GYAE6OF01EJ5Y5.27.23.C01.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcacntctctgcactggaacccngatgacgttggntctttataactttntcttgttcggtaccgacacggacccaggcactcgtaccccaaatctatttctttatgtattgtacaagtactcccggaccccgttaggggtttctagtacttccgtctttacgtacgtcggtacctaccgtaagttcctcgtaccctaacgtaccggtcccctcccgtacgtaacccgtacgtcccggtcccgggtcctacccgaacggtccccgtagggaaccgggtaaccggtacggttaccgtaaggtttaatttttaagtttaacgttttacggtttaacgtttctaaactttaactaaccgtaacccgtaggttacgtaaccgttacgggtttgggggttacgggtttaccggggacggggtaacggtacccggtagggtccgttaacggacccgttacggtacgggtaccgaccggtacccggaagggtcccgtcccggttccccggttacggttaccctaccgttcccggtttcccgtcccccgtccccgttaccgg

SEQ ID NO: 274434 - DNA, 569 bp, Homo sapiens
  misc_feature: GYAE6OF01A46O6.27.23.C01.1.454.CMB.1.raw
  modified_base (229)..(229): a, c, t, g, unknown or other
  misc_feature (229)..(229): n is a, c, g, or t
  modified_base (514)..(514): a, c, t, g, unknown or other
  misc_feature (514)..(514): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataactttatctgttggtaccgacaggacccaggcactgtccccaaactcattctttatgatgtcagtaactcggccccaggggtttctgatcgtcttctatcggtctcaagtctcgcctacacggtcctccctgaccatccgtccgggctccgacgtcctcgacggacgaggctagatttatagtttgtagttcatactacaaccagtgaacgtacttgggtcgttcgggcgggtacgggaccaggtcgtcggaccgtaccgtcggcnccggcccaacggcctcgccccctcggtccactcgtcgttccccgtccctaccccg

SEQ ID NO: 274435 - DNA, 747 bp, Homo sapiens
  misc_feature: GYAE6OF01DRI3H.27.23.C01.1.454.CMB.1.raw
  modified_base (246)..(246): a, c, t, g, unknown or other
  misc_feature (246)..(246): n is a, c, g, or t
  modified_base (310)..(310): a, c, t, g, unknown or other
  misc_feature (310)..(310): n is a, c, g, or t
tcagagcgtcgtctcacgaccggtgctcgatttagtacacgtgattagggattgggggggggtctcagggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtncttatacttatctgttcggtaccgacacggaccaggcactcgtaccccaaatctatttctttangtatgtacagttaacgtccggaccccgttagggtttctgtactcgtcttctagtcggtcctaccgtaagttctacgtcctaaccgccggtccctcccgtagaaccctacgtcccgtacccgggcctaccgacgtccgtagggtacgggaaccggtaggtaccgttaggttaaattttacgtttaagtttacgtttaacggtttacctaaactttaacctaaacgtaaccccgtagttacgtaaaccgttacgggtttaggggtcgggtttaccggggacgggtacgggtaaccgacggggtccttaccgggtaccggtcccggttaacgggtaccgtaacccgggtacccgtacgggtcccgtcccccggtacccccgttacgggttacccctaccgttccccggtttacccgttcccccggtccccttaacccggg

SEQ ID NO: 274436 - DNA, 853 bp, Homo sapiens
  misc_feature: GYAE6OF01BUUAH.27.23.C01.1.454.CMB.1.raw
  modified_base (245)..(245): a, c, t, g, unknown or other
  misc_feature (245)..(245): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgcgatgacgttggngactttaataactttatcttgttacggtaccacacggaccaggcactcgtaccccaaacttctatttactttagagtattcgtacgtaagttaaccgtcccggtacccccggtaggggttttcctacggtacgttccgtcttttacgttacgtcggtaccttaccgtaaacggttccgtacgtaccccgttaaccgacccggtccccttacccgtacgtaacccgtacgttcccggttcccgggcccttacccggacggtcccgtacgggacgggtaacggtacggtaccggttacgttaactttttaacgtttagtttacgggtttaacgttacctaaattaaccgttaaccctaaaccggttaacgggttaccgaaccggtttacgggttttacggggttaccggggtttaccggggtacccggggtaacgggtaacccggtacgggtacccgttaccgggtaaccccggttaccggttaacgggtacccgtaaccgggtacccccggttaacgggtccccttcccccgggaccccccggtttacgggttaccctacccggttttaccccgttaccccgttaccccccgtaccccgtttaccccgg

SEQ ID NO: 274437 - DNA, 677 bp, Homo sapiens
  misc_feature: GYAE6OF01EV9Q2.27.23.C01.1.454.CMB.1.raw
  modified_base (243)..(243): a, c, t, g, unknown or other
  misc_feature (243)..(243): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccccgcgatgacgttggtncttataacttttatcttgttggtaaccgacaggtacccaggcaactgtccccaaacgtctattctttatgatgtcagtaatccggccccgagggtttctgattcgcttctatggcctctagtctgacctacgaccgtcctccctacgaccatcctccgggctccgacgtcctggaacggacgacgggtcttacggtatttacgtttagtttcggttaagtttccgaattactaaccgtaacgtagttcgaacgttaccggttggggttaacgtttccggggaaccggtaggggtacccagggtccttacggtacccggttaccgtacgggttacccgacggtaaccccgtaaggtcccttacccgggtcccccccgttacgggttaccctaacccgtttcccttaccgggtttccccccacccgttacccccgg

SEQ ID NO: 274438 - DNA, 669 bp, Homo sapiens
  misc_feature: GYAE6OF01BNB9Z.27.23.C01.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctctcactcaggcacagggtcctgggcccagtctgccctgactcagcctgcctcgtgtctgggtctcctggacagtcgatcaccatcctctgcactcggaacccgngatcgacgttggtnctttaatactttntctgttcggtaccgacgacggaccgaggcacgtcgtacccctaaactctattctttatgtatcgtacgtagtaacgtccggccccgtagggtttctgtactcgcttctagtcggctacgaagtctacgcctacgaccgtccctcctacgaccctagtccgtccgggcctccgacgtccgtaggacggaacgtcgtacgtagtatttacttagttagttacttactaacttactaactaaccgtagtacgtacgttacggttggttacggttcggacgggtaacggtaccgtacggtcgtaccgtaccggttaccgtacggtaccgaaccgtacccgtaacggtcccgtaccccggttcccccgttacggttaccctacccgtttaccgttcccgttacccccgtaccccgtcccg

SEQ ID NO: 274439 - DNA, 761 bp, Homo sapiens
  misc_feature: GYAE6OF01BNGQK.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttataactttntcttgttcggtaccgacaggacccaggcactcgtaccccaaactcatttctttatgtatgtcaagtaactccggccccgtaggggtttctgtacgtcgtacttctacgttcggcttaccgaagttcgtacgtaccctaccgaccggtccctacccgtcgaaccctacgttccgtcccgggtcctcccgtacggtcccgttacgggacggaaccggtacggtacgttacggtaacttttaagtttacgtttaggttacgtttacctaattaaccgttaaacctaaaccgtaggttacgaaccggttaacggttttacgggggttcggtttaccggggaccggggtaacggggtacccgtacgggtcccgttacggtaccccggttaccgttaacggggttaccgaaccgggtaccccgaaacgggtcccgttccccggtaccccccggttaccggttacccggtaccctttaccgttcccccgtttacccccgtccccgttaccccgg

SEQ ID NO: 274440 - DNA, 757 bp, Homo sapiens
  misc_feature: GYAE6OF01CFK5Z.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatggacgttggtgtacttataactttatctgttgtaccgacacggacccaggcactaccgtacccaaactcatttctttatgatgtactaagtaacgtccggccccgtaggggtttctagactcgtcttcgtagtcggcctacagttcctcgcctacgaccggccctccctacgtaacctacgtccgtacccgggtcctacccgacgtacccgtaggacggtaacgggacggtcgtaacgtaagttttacgtttaagtttacggtttaagtttactaagtttaactaacccgaaaccgtaggttacgaaccgtttacgggtttacggggttacgggtttaccgggggaccggggtaaccgggttaaccggacgggttaaccgttaccgggtaaccccggttacccgttaacgggttacccgtaaacccgggtaccccggaacggtcccgttacccccggccccccgtttacgggtcccttaacccgtttcccgttccccggtttaccccctaacccccgttacccg

SEQ ID NO: 274441 - DNA, 652 bp, Homo sapiens
  misc_feature: GYAE6OF01DVQSW.27.23.C01.1.454.CMB.1.raw
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctcgtgtctgggtctcctggacagtcgatcacatctcctgcactcgaacccgcgatgacgttggtgcttataacgtttatcgtgttaggtaccgacacggacccaggcactcgtacccaaactctagttctttangtatgactaagtaacgtccggtccccggtagggtttctagtactcgtnttcgtagtcggtcctaccgtaagtcctagccctaacgcccggtccctccctaggtaaccctacgtccggtcccggtctcctaacggccgttagacgggaacgtacgtcttagtaattagtttattggttacttacaattactacaactgtacgaacttacggttgggtacggtttcgggacgggtagggtaccagggtcgtaccggtaccgtaccgtggacccgtacgtaccccgaggtcctacccgtccccgttacggtcccttaagtcccggttaccctccccgtcctacccg

SEQ ID NO: 274442 - DNA, 797 bp, Homo sapiens
  misc_feature: GYAE6OF01BB2EF.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgccactcggaacccgcgatggacgttggtgcttataactttatctgttggtaccgacaggaccaggcactcgtaccccaaatctattctttatgatgtcagtactccgggtacccctaggggtttctagtatccgtcttcgtagtcggcctacgaagtctcgaccctacgtaccggtcccttacccgtagacccctacgttcccgtacccgggtctacccgtacggtacccgttagggaacgggtaaccggacggtaccgttaagttaaacgttttacgtttaagttttcggtttaacgtttaccgtaaatttaacccgttaaacgtaaaccccgtagggtttaacgttaaccgtaccggggtttttacgggggttaccgggtttaccgggggaaccggggttaacggggttaacccggaacgggttcccgttaccgggtaaccccggtttcgtaaaccggggtacccgtaacgggtaacccccggtaacgggtaccccgtttcccggtacccccccgttacggggttaccctaccggtttacccgtttcccggtttccccccgacccgtttacccccgg

SEQ ID NO: 274443 - DNA, 632 bp, Homo sapiens
  misc_feature: GYAE6OF01EUHX9.27.23.C01.1.454.CMB.1.raw
  modified_base (226)..(226): a, c, t, g, unknown or other
  misc_feature (226)..(226): n is a, c, g, or t
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcacatctcctgcactggaacccngatgacgttggtctctttaataacttttatcgttgttcggtaccgacgacggacccaggcaactcgtccccaaatctattcttatgtatgtacagttaacgtccggtccccgttaggggtttcctgtactcggtcttacgacgtcggtacttaccgagttcctacggtccctaacgaccggtccctccgtacggacctcgtaccgtccgggctccgagtccctaggacggtcgaacgtctagtagtttattattcgtacgttanactactacgaacagtnaacgtacgttgggtgttccggagggtacggtacgaggtcgtagaccggtccgtaggtccgacgacccgtaggtccgtacccgtcccgttcggtaccctacgtcccgtttcgtcccctcccgtaccc

SEQ ID NO: 274444 - DNA, 720 bp, Homo sapiens
  misc_feature: GYAE6OF01EKQU6.27.23.C01.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (270)..(270): a, c, t, g, unknown or other
  misc_feature (270)..(270): n is a, c, g, or t
  modified_base (709)..(709): a, c, t, g, unknown or other
  misc_feature (709)..(709): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctcgccctgactcacgcctgccctcgtgtcgtgggtctccgtggacngtcatccaccatcctctgcacgtacggaccgngatcggtacgttggtctactttaacttaactttntcttggttcggtaccgacgacggtacccgaggctacgtccgtaccccaaactcttatttactttacgtgtacgtcgtactaggtaaaccgtccccgggtaccccgttaggggtttctagtacttccgtctttactagttcgtccttaccgtaacgttcctacgtaccctaaccggtacccggttccctaccccgtacgtaccctaccgttcccggtcccgggtcctaccgaccggtccgtagggacgggtaacggtacgtacgtagttactttatttacgtttattacgtactattactaaccgacgtagtacgacgttcggttgggtcggtcggacgggtacggacgtcgcgtacgtcccgttacgtacggcgaccggtcccgtacggcccgttcccggtaccccgtcggtaccctccgttccgtccccgttaccccnccgttacccgg

SEQ ID NO: 274445 - DNA, 778 bp, Homo sapiens
  misc_feature: GYAE6OF01B4X9X.27.23.C01.1.454.CMB.1.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
tcagagcgtcgtctcacgaccggtgctcgatttagtacacgtgattagggattgggggggggtctcaggaggcagcgctctcgggacgtctccaccatggcctggctctgctattcctcaccctcctcactcagggcacgagggtcctgggcccagtctcgccctgactcagcctgcctccgtgtcgtcgggtcctccgtggactagtcgatccacctatcctcctgcacgtcggaacccgngtatcggtacgttggtntactttaattaactttntcgttggttacggtaccgacgtacggaccgaggccactaccgtacccctaaacttctatttactttagtatatcgtacaacggtaaccgtcccgggtaccccgttaggggtttctaggtactcgtactttcgtagttcgtaccgtactaaggtcctaccgacccgtaaccgcccggttccctcccgtacgtaaccctaccgttcccggtaccccgggtccctaccggaccgtaccggtacgggaaccgggtaccgggtaacggtacgttaggttaactttaagttttacgtttaaggttacttaacgtaaacttaacgtaaaccgtaacgttacggtacgtacggttacgggtttacgggttcgggtacgggacgggtaacgggacgtcggtaccgtacggttaccgtcggttaacgccggaccggtacccgtacggtcccgtacccggtcccccggttacggtaccctccgttccccgtcccggttcccctcccggtaccg

SEQ ID NO: 274446 - DNA, 677 bp, Homo sapiens
  misc_feature: GYAE6OF01ELDBC.27.23.C01.1.454.CMB.1.raw
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (323)..(323): a, c, t, g, unknown or other
  misc_feature (323)..(323): n is a, c, g, or t
  modified_base (665)..(665): a, c, t, g, unknown or other
  misc_feature (665)..(665): n is a, c, g, or t
tcagagcgtcgtctcacgaccggtgctcgatttagtacacgtgattagggattggggggggtctcaggaggcagcgctctcgggacgtctccaccatggcctgggctctgctattcctcacccctcctcactcagggcacgagggtcctgggcccagtctgccctgactcagcctgcctcgtgtctgggtctccgtggacagtcgatcaccatctcctgcacgtcggaacccgngatggacggttggntactttataactttntcttggttaggtacccgacgaggacccaggctactcgtacccccaaatctatttctttangtatgtctagtaactcccggccccgtagggtttcagtactcgtcttctagtcggtcctacctaagtccgtcgtcccctaccgcccggtcccttccccgtagaacccctacgttccccgtccgggtcctcccgacgtcctagggacgggacgacgggcttagtatttactttagtttcggttattacctataactaacaaccgtggtacacgttcggttgggtggttccgggacgggtacgggacctacggtctcggtacccgtccggtaaggtcccgacggaccccgtaggtccccgtcccgtcccccgttacggtccgtaccttccctcccgtttcccccncccgttaccccg

SEQ ID NO: 274447 - DNA, 712 bp, Homo sapiens
  misc_feature: GYAE6OF01AL6FA.27.23.C01.1.454.CMB.1.raw
  modified_base (241)..(241): a, c, t, g, unknown or other
  misc_feature (241)..(241): n is a, c, g, or t
  modified_base (548)..(548): a, c, t, g, unknown or other
  misc_feature (548)..(548): n is a, c, g, or t
  modified_base (605)..(605): a, c, t, g, unknown or other
  misc_feature (605)..(605): n is a, c, g, or t
  modified_base (643)..(643): a, c, t, g, unknown or other
  misc_feature (643)..(643): n is a, c, g, or t
  modified_base (701)..(701): a, c, t, g, unknown or other
  misc_feature (701)..(701): n is a, c, g, or t
  modified_base (709)..(709): a, c, t, g, unknown or other
  misc_feature (709)..(709): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctctcacgtcagggcacgagggtcctgggcccagtctgccctgactcacgcctcgcctccggtgtcgtgggtcctccgtggacaggtcatcaccatcctcctgcacgtacgggaacccgngaagtggtacggttgggtctactttaataacttttatcgttggttacggtaaccgcgacggacccaggcctactccgtaccccaaacgttctacgtttactttagtacgacgttcgtactaaacggttaaccgttccccgggaccccgttacggggtttctacggtacgttccggtactttcgtacgtcggtaccctaacggtaacgtccgttaccggccttaaccggcccggttcccttcccgtacgaacccgttaccgtcccggtaccggtcctaccggtaccgtcggtaacgggacggtacggnggttaccttgttaatttagttacgtttaacggttattactattaacgacctaacgtnacgtacgtaaggttgggtacgtcgggacggtagaccgngacttacggaccttaggagccgacgccgagtccgtcccgctcgtacgctaccgttccncccgttcnccg

SEQ ID NO: 274448 - DNA, 939 bp, Homo sapiens
  misc_feature: GYAE6OF01C4RUR.27.23.C01.1.454.CMB.1.raw
  modified_base (319)..(319): a, c, t, g, unknown or other
  misc_feature (319)..(319): n is a, c, g, or t
  modified_base (406)..(406): a, c, t, g, unknown or other
  misc_feature (406)..(406): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctcgccctgactcagcctgcctccgtgtcgtgggtcctcgtggacagtcgatccaccatcctcctcgcctaccgtaccggaacccgcgtagtgtacggtttgggtctactttaattaacttttactcgttcggttacggtaccgaacgaaccggaacccgnggacctaccgtaccgtacccctaaactcttactttactttatcgtattgtacgacgttaaccgtcccggtaccccggtaggtttcgngtacttcgtcttcgtagtcggtactaccgtacgttcgtccgtaccgtaaccgtcccgtcccctaccgtactaacccgtacgttccccggaccccggtccgttacccgaccggtccggttaacggggaaccgggtaacccgggtacgggttaccgtttaacgttttaaaccgtttttaaagtttttaacggtttacggttttaacttaaactaacctttaaacccgtaaaccgttaaaccggttagggttaaccggttaaacccgttttacggggggttttacggggtttccggggtttacccggggggaacggggttacccggggaccggttaccgggttaccggttaacccggggtttaccccctaagggggtttaccgaaaaccccgttaccccgggggtaaacccccggttaaggggtccccccgttacccccgggtttacccccccgggttaacgtttaccccggtttaaccccgttttccccgtttacccccccggttacccccccttaacccccgggtttaaccccg

SEQ ID NO: 274449 - DNA, 683 bp, Homo sapiens
  misc_feature: GYAE6OF01A6CNU.27.23.C01.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccntctctgcactggaacccngatgacgttggntcttatactttntctgttcgtaccgacgacggaccaggccactcgtacccctaaatctatttctttatgtatgtctagtactccggtccccgtagggtttctgtactcgtacttcgtagtcggtctaccgaacgttcctacgtacccgtacgaccggtccctcccgtacgtaccctacgtccgtcccgggtacctaccgacgtccggtaggacggacggtcggtacgttagttaatttagtttagttacgttacgttactaacttaacgtaacctaacgtagtacgtacgttacggtttgggtacggttacggggtacgggaacgggacgtacgggtcgtaccggtacccggtcggtaacggtccgaccgtacccgacggtcccgtacccggcccccgttaccggtcctacccttcccgttccccgttccccctcccgtacccg

SEQ ID NO: 274450 - DNA, 654 bp, Homo sapiens
  misc_feature: GYAE6OF01BWC7R.27.23.C01.1.454.CMB.1.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctcgtgtctgggtctcctggacagtcgatcaccatctcctgcactggaacccngatgacgttggncttatactttntctgtgtacacaggacccaggcactcgtacccaaactctattctttatgatgtctagtaactccggccccgtagggtttcagtatccgtcttacgtagtcggacctccgtaagtcctacgacccttacgaccggtccctcccgtacgaccctacttccgtcccgggtccttaccgacgtcccgttcggaacgggtaccgaggtccttaggttaatttacgtttagtttggttaacgttctaagttaacctaacaaccgtagtacggtacctaacggtttggggtacggtttcgggacgggtacgggaccagggtcctcggacccgttcgtacggtcaccggacccgtacggccttaccgcccccgttacgtcctacccttcgtcccgttccccgcccttacccg

SEQ ID NO: 274451 - DNA, 790 bp, Homo sapiens
  misc_feature: GYAE6OF01DPL9F.27.23.C01.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (467)..(467): a, c, t, g, unknown or other
  misc_feature (467)..(467): n is a, c, g, or t
tcagagcgtcgtctcacgaccggtgctcgatttagtacacgtgattagggattggggggggtctcaggaggcagcgctctcgggacgtctccacatggcctgggctctgctattcctccaccctcctcactcagggcacgagggtcctgggcccagtctcgccctgactcacgcctcgcctccgtgtcgtgggtctccgtggacngtcactccacctactctcctgaccacgtacggaacccgngtagtcggtacggttggtacttacttaattacttacgttcgttggttaccggtaaccgaacgaccggaacccgtggtacctaccgtaacctaaccctaaacttcttattttacttagtagtacgtacgtacgtaacgtaccgtccgggtaccggttaggtttcacgtctcgtcgtacgtgtccgtacgtactacgtctaccgtaccgtaccgcccgttacccncgtaccgtaccgtccgttcccgggcgtacccgtacggaccggtacggtaacggggaacgtaccgtagttacgtttaagtttaactttaagtttacgtacgtttaaaccacgttaacgttaaacctaaccggtacgttacggtacggttaaccggtttggggttccgggtacggacccggggtaggtaacccggttacgtacgtaccggtaccccggtacgtacccgggtcgaaccccgtaccggttacctccgggtaccccctccccgttacggttacctccccgtaacccggtttcccctacccgtaccctccggtaacccg

SEQ ID NO: 274452 - DNA, 725 bp, Homo sapiens
  misc_feature: GYAE6OF01A1AXF.27.23.C01.1.454.CMB.1.raw
  modified_base (236)..(236): a, c, t, g, unknown or other
  misc_feature (236)..(236): n is a, c, g, or t
  modified_base (345)..(345): a, c, t, g, unknown or other
  misc_feature (345)..(345): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatcctcctgcacgtcggaaccccgngatcggtacggtttggtagtctttaagttaacttttatcgttggttcggtaaccgacgtacggacccaggacctacgttaccgtaccccaaacttctaactttctttanacgtattcgtactacggtaaccgtcccgggtacccccgttaggggtttcctaggtacttccggttcttacgtagtcggtcctaacctaaggttcttaccgcccctaacgacccggttccctaccccgtacgaaccttccgttccggtccccggtacctcccgacggttacccgtaggggacgggtacgtacggtccgttagtttaacttttacgtttagttacggtttacttaccaagtttaaccaacgtaaccgagtacgtacgttagggtttcgggtcgtcggggtacgcgggaactggcctacggaccgttcgtacggtccgacgtaccggacgtctccccgtcccgtgtccctccgttcctacctccctacgtccg

SEQ ID NO: 274453 - DNA, 772 bp, Homo sapiens
  misc_feature: GYAE6OF01CBVAH.27.23.C01.1.454.CMB.1.raw
  modified_base (242)..(242): a, c, t, g, unknown or other
  misc_feature (242)..(242): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcgagggcacgtagggtcctgggcccagtctcgccctgactcagcctgcctcgtgtctgggtctccgtggactagtcgatccacctatcctcctgccacgtacggaacccgngagtcggtacggtttggtactactttaattaactttgtcgttcggttacggaccgagacggaccaggtccaccttccgtacccctaaactcgttaatttctttagtgtacttcgtacctaacggttaccgtcccggtaccccgggttaggtttctcggtacgttccgttacgtttcgaacggttcgtaccgtaaccgtaacgtttccgtaccgtacccgtaaaccggtacccgttccccgtaccgttaccgaaaccgttcccgttcccgggtaccccgggtcctaccggtacgtccggtacggacgggtaccggtagtaccgttaagttaatttacgttacggtttagttaacgttaactacgttaacgtaacctacgtaacgtacgtacgttacgggttacgggtacggttcgggacgggacgggtaccctaggtccggtaccgtaccggttacgacggtacgaccggacgtaccggtccgtacccgtcccgtacgtcctaccgtcgttaccccgtcccgtcccgtacg

SEQ ID NO: 274454 - DNA, 763 bp, Homo sapiens
  misc_feature: GYAE6OF01B9OID.27.23.C01.1.454.CMB.1.raw
  modified_base (377)..(377): a, c, t, g, unknown or other
  misc_feature (377)..(377): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcaccatcctctgccacgtcggaacccgcgtatggtacggttggtcgtactttaattaaccttttatcgttggtttacggtaccgacgacggaccctaggcctacgtcgtaccccaaacttcgtaatttctttaatgtatgtacagtaacgtccggaccccgttagggtttcngtactcgtacttgtacgtcgtcctacgaagttccgtacgtaccctaaccgtacccggtccctacccgtacgaccgtacgtcccggtacccgggtacttccgacggtctacgggacggacgtacgtcgtaagttactttaagttacgtttaggttaagttactaacgttaactaaaccgtaacgtacggtacgtaccgttacgggtttacggggttcggttaccgggacgggtaaccgggtaccgtacggtaccgttccggtaaccccgttaccggtaacggtccgtaaccgggtaccccgtaaagggtccccgtaccccggtaccccccgggttcgtacccttacccggttccccgttcccggttcccccccgtacccttacccgg

SEQ ID NO: 274455 - DNA, 752 bp, Homo sapiens
  misc_feature: GYAE6OF01BDLXH.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaaccccgcgatgacgttggtgctttaataacttttatctgttcggtaccgacacggacccaggcactcgtccccaaactcatttctttatgtatgtcagttaactccggtacccccgtaggggtttctgtactccggtctttactacgttcggtcctaccgtaacgttctacgccctacaccggtccctcccgtagaccccgtatcccgtcccggggtccttaccgacggtccgtagggacgggaaccggtaacgggtcttaggtaacttttagttagttttaggtttacgtttactaagttaacgttaaccgtaacccgtaagttcgtaaccgttaaccggtttggggttacgggtttccgggtaccgggggaacgggtaacccggacgggtccgttacggaccccggttaccgttacgggttacccaacgggtaccccgtaaacggggtctcccggtcccccccgtttacggggtacccttacccgttcccggttcccggtttaccccccggtccccttacccgg

SEQ ID NO: 274456 - DNA, 776 bp, Homo sapiens
  misc_feature: GYAE6OF01A82F3.27.23.C01.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgtcctgactcagcctgcctccgtgtctgggtctccgtggacagtcgatcaccatctcctgcacgtcggaacccngatgacgttggngtactttaataactttatcttgttacggtaccgacacggaccaggcactcgtaccccaaactctacttactttatgtatcgtctaagtaacgtccggtaccccgtaggggtttctgtactcgtcttctagtcggcctacgaacgtctacgaccctacgaccggtccctccgtacgtacctacgtcccgtcccggtcctccgacgtccgtacggaacggtacggtacggtacgttaacggttaatttaacgtttagtttacggttaacgttaccgtaacttaacgtaaacccgtaacgttaacggttacggttaacggtttaccggggttttacggggttaccgggttaccgggggtaaccggggtaacgggtaacccggtacggtaccgtacccgggtaacccggttaccgggtaaccggtaaccgtaacccgggaacccggtaaccgggtcccgttaccccgggtccccccgttacgggttacccttacccggtttcccgttaccccgttcccccgtacccccgttacccg

SEQ ID NO: 274457 - DNA, 675 bp, Homo sapiens
  misc_feature: GYAE6OF01BNQW7.27.23.C01.1.454.CMB.1.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
  modified_base (269)..(269): a, c, t, g, unknown or other
  misc_feature (269)..(269): n is a, c, g, or t
  modified_base (326)..(326): a, c, t, g, unknown or other
  misc_feature (326)..(326): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacngtcgatcaccatctcctgccactcgggaaccccngatcggtacggtttggcgtactttaataacttttntcttggttacggtaccgacacggacccaggcactcgtaccccaaatctattctttangtatcgtactaagtaacgtcccggacccgttagggtttctgacttcgtctttacgtagtcgactacgtaagtcgtacgtccctacgccggtcctacccgtagacctacgtccgtaccggtctaccgacgtccgtaggacggacgtagtactagtatttaattagttacgttagtactaatactaaccaacgtgacgtacttaggttcgggtacggttcgggacggtaacggtaccgtaggtcgtacggtaccgttacggtaacggtcgaaccggtaccgaaccggtcgtaccccggtccccgttacggtcctacccgttaccgtcccggtttccccgcccgttaaccgg

SEQ ID NO: 274458 - DNA, 684 bp, Homo sapiens
  misc_feature: GYAE6OF01EYU10.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatcgacgttggtcgctttaataactttatctgttggtaccgacaggacccaggcactgtaccccaactcatttcttatgactgtactagtaactccggccccgtagggtttctgacgttccgtcttctagtcggctccgtaatctgtccctaacgtaccggtccttcccgacgtaccactccgtccggcctcacgtcccgtagacgggtacgcggtctagttaacgtttacttaagtttggttacgttactaagttaactaacctaaccgtagtaacgtaccgttaacggttcggggttccggtttcggacggggtacgggtaacccggaggtccgtacggtacccggttaccgtacggtccgaacgggtaccccgaaaggtcccgttaccccgggtcccccgtaccgggttcctacccgttaccttccccggttaccccttccccgtacccg

SEQ ID NO: 274459 - DNA, 736 bp, Homo sapiens
  misc_feature: GYAE6OF01BDTJS.27.23.C01.1.454.CMB.1.raw
  modified_base (688)..(688): a, c, t, g, unknown or other
  misc_feature (688)..(688): n is a, c, g, or t
  modified_base (729)..(729): a, c, t, g, unknown or other
  misc_feature (729)..(729): n is a, c, g, or t
tcagagcgtcgtctcacgaccggtgctcgatttagtacacgtgattagggagttgggggggggggtctcaggaggcagcgctctcgggacgtctccaccatggcctgggctctgctattcctcaccctcctcactccagggccacgagggtcctgggcccaggtctgccctgactcagctgcctccgtgtctggtctcctggacacgtcgatccgaccatcctccgtgccacgtcgggaaccccgcgaagtcggtaacggtttggtacgtactttattaacgtttactcgttgttacggtaaccgtaccgtacggacccaggcctacgtaccgtacccccaaacgttcctaacttttacgtttagtacgttactcgttaccgtaacggttaaaccgtcccgggtcccccgttaaggggttttcctagtaccttcggtacctttactcggtacgtcctacgtaagtcctacgtacctaccgacggtcccttcccgacgacctacgtcccgtaccgggtcttacccgacgttcccggaggtaacgggtacggtaccgtacgtacgttacgtttaacgtttacgtttacgttacggtacttaaacgtacgtaaaccctaacggtcgtaacgtacgtcgggttagggtcgttacgggcggtacgcgacggtctcggacgtccgtagcgtacncggagcctccgtccccgtggtccacgttcgaccgtccccgngtacccg

SEQ ID NO: 274460 - DNA, 825 bp, Homo sapiens
  misc_feature: GYAE6OF01BFUTU.27.23.C01.1.454.CMB.1.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (318)..(318): a, c, t, g, unknown or other
  misc_feature (318)..(318): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacagtcgatcaccatcctcctgccacgtcggaacccgngatcgacgttggtntcttataactttntcttgttcggtacgacacggaccaggcactcgtaccccaaactctactttctttangtattgtcgtagtacgtcccggtccccgtagggtttctgtacttcgtacttacgtagtcggtctacgaacgttctacgccgtacgaccggtccccttaccgtcgaccctacttccggtccccgggtcctacccgagtcccgtagggaacgggacggacggtccgttagttaacgtttaagtttagtttacggtttaacgtttaaccgtaacttaaacgttaacccgtaaacccggttaggtttaacgggtaaccgtttaacggggttttcgggggttaccggggtttaccgggggtaccggggtaaacggggttaacccggacggggttacccggttaacccgggttacccgggttaacccggttaccggggtacccaacccggggttaaccccggaacccggggttcccgttacccccgggttccccccggttaccggggtaaccccttacccggtttacccgtttaccccccggtttacccccgtaccccggtttaaccccccgg

SEQ ID NO: 274461 - DNA, 754 bp, Homo sapiens
  misc_feature: GYAE6OF01CKDOK.27.23.C01.1.454.CMB.1.raw
  modified_base (236)..(236): a, c, t, g, unknown or other
  misc_feature (236)..(236): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatctcctgcacgtacggaacccgngagtcgtacgttggtctactttaattaactttgtcgttaggttacggtaccgacgacggacccgaggcctaccgtaccgtaccccctaaatcttaacgtttactttagtgtattcgtacgtaacggtaaccggtcccggtaccccggttagggtttcagtacgttcgtcttacgtacgtcgtacctaccgtagttcctcgacctaccggtccggtcccttaccgacgtacctcggtccccggtccgggtcctaccggacgtccggtagggaaccggacgtacggtcttaagttaatttagtttagttacggttactacgtaactaccgtaaactaactggtacgtacgttacgggttggggttaccggacggggtacggacggtacgacgggtaccgtacggtaccccggttacgtcgggaaccctaccgggacccgtacggttccccgtaccccggttaccccggttcgtaaccccgtttcgtaccccggtttcccgttcccccgtccgttacccgg

SEQ ID NO: 274462 - DNA, 759 bp, Homo sapiens
  misc_feature: GYAE6OF01ELTN5.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccccgngatcgacgttggtgtactttaataactttatcgttgttcggtaccgacacggacccaggccactcgtacccaaactctatttctttatcgattgtcacgtaacgtccgggacccccgtaggggtttctgtacttcgtcttactagtcggtacctaccagttcgtcgacccctaacgaccggtccctcccgtacgtacctacgttcccggtcccgggtacctcccgaacggtcccgtagggaacggtaccgggacggtacgttaggttaattttagtttacgtttaggtttaagttaccgtaaattaaccgtaacctaacgttacggttacgtaccgtttacgggtttacggggttacgggttaccggggacggggtaacgggtaccggacgggtaccgtccgggtaacccgttcccgttaacggtacccgtaaccgggaccccgtaacgggtccccgtccccggtacccccgttaccggtcccttacccgttcccgttacccgttaccccccgtcccctaccccgg

SEQ ID NO: 274463 - DNA, 905 bp, Homo sapiens
  misc_feature: GYAE6OF01DXVQB.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctacttcctccaccctcctcactcggacggactacggcgggtccgtcggacctacgtcgtccgccgtcgtactcgacgtccgtcgtccgtcgttcgtcgtcggtcctcgtcgacgtacgacgtactaccactactccgtccgtacgaccgtaccggtaaccgaccggtacggttacgttcgggttacggtttacggtacgttttaaacttttaaacgtttacgttttaaccgttacggtttaccgggttaaccggtaacccgaaccggaaccggtaacccggtaccgtaccggtaccttaacccgtaaccctaaacttacttttccgtttacggtaactcggttaaaactaccggggtaaccctacggggtttaccccttacggggttaaccttcgggtaccttaccggtacttccgggtacttaccgaacgttccgtacgtccgtacgtaccggtacctccccgtaccgtacccgtacttacccgtaccggtcctacccggtaccgtccgtaacgggtcccgaacggtacgggtaacgtcgggtaactttacggttaacgtttacgttagttaacgtaacgttacttaacgaacgtacgtaacacggttacgtacgggttacgttacggggttaccggtacgggtaaccggtacggaccggtacggtaccgtaccgacggttccgtacggtccctaaacgggtcccgttacgggaccccttacgggtcccgtaacccggtacccgtttccgtaccctacccggtacccttaccggtacccgtccggaacccgg

SEQ ID NO: 274464 - DNA, 725 bp, Homo sapiens
  misc_feature: GYAE6OF01DM3XV.27.23.C01.1.454.CMB.1.raw
  modified_base (235)..(235): a, c, t, g, unknown or other
  misc_feature (235)..(235): n is a, c, g, or t
  modified_base (415)..(415): a, c, t, g, unknown or other
  misc_feature (415)..(415): n is a, c, g, or t
tcagagcgtcgtctcacgaccggtgctcgatttagtacacgtgattagggagttggggggggtctcaggaggcagcgctctcgggacgtctccaccatggccttggctctgctattcctcaccctctcactcagggcacgaggtcctgggcccagtcctgccctgactcagtcctgcctcgtgtcgtggtctccgtggactgtcgatcacctatctctgacacgtcggaacccgngtagtgtacggttggtagtactttaattaactttagtcgttaggttacggtaaccgaacgacgggaacccacggtacctaccgtccgtaacccccaaacttcttacttttacctttagtcgtattcggtactaggttaaccgtcccggtaccccggttagggtttctacgactcgtcttnacgtcggacctacgtagtctcgccctaacgccggtccctaccacggtacctcgttacccgtccggtacctccgacggtaccgtacggacgggtacgtacggtacgttagtattttaagttcgtttaggtacgttacaacgttaactaacaacgttagtacgtaccttaagggtttcggtaccgggtacgggacggtaacggtcgtacgtcgtaccgtacccgtacggtgtaccgacggtacccgacggttcccgacccggtcccggtcgtaaccgtccctttccggtcccgtttaccccgcccgttaccg

SEQ ID NO: 274465 - DNA, 835 bp, Homo sapiens
  misc_feature: GYAE6OF01AYRY6.27.23.C01.1.454.CMB.1.raw
  modified_base (231)..(231): a, c, t, g, unknown or other
  misc_feature (231)..(231): n is a, c, g, or t
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcacgtcggaacccncgatgacgttggtgtcttataactttatctcggttggtaccgacacggacccaggcactcgtaccccaaacttcactttctttangatcgtacagttaactccggccccgtaggggtttcngactcgtcttcgtacgtcggcctaccgtaagttccgtacgtaccctaccgtaccggtcccctccccgttagaacccctacgttcccggtcccgggccctacccgaccggcccggttacgggaacgggtaaccgggacgggtaccttacgggttaaactttttaacgtttacgttttacggtttaaggtttacctaaacttaaccgttaaaccctaaacccgtaacgggtttaccgtaacgttaacccggggtttttgggggttaccgggttttcccggggaaccgggggttaacggggaaccccggtaacgggtcccggtttaaccgggaaccccggtttaccggtacgggttaccccgaaaccgggacccccggtaaacggggtcccccttaacccccgggtccccccggtttacccgggttacccttaacccgtttccccggtttccccgtttaaccccccggtaccccccgtttaccccg

SEQ ID NO: 274466 - DNA, 693 bp, Homo sapiens
  misc_feature: GYAE6OF01BLDTB.27.23.C01.1.454.CMB.1.raw
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacacggacccaggcactcgtaccccaaactctattctttatgtatgtcagtaacgtccggccccgtagggtttctgtacttcgtcttctagtcggtacctcaagtctcgcctaccgaccgtccctccctagacctacgttccgtcccgggcctaccgacgtccgtacggacggaccgaggtccttaggtaactttatttatttacggttattctaattactaactaacgtagtacgtaacgtacggtttagggtcggttaccggggacgggtaacgggaccgtaacgggtccgttaccgggaaccccgttaccgtaagggtcccgtaaccggtaccccgaaacgggtcccttccccgggtccccccgttccgggttaccctacccgtttcccgttccccggtttacccccgtcccccgttaccccg

SEQ ID NO: 274467 - DNA, 806 bp, Homo sapiens
  misc_feature: GYAE6OF01CW7E0.27.23.C01.1.454.CMB.1.raw
  modified_base (208)..(208): a, c, t, g, unknown or other
  misc_feature (208)..(208): n is a, c, g, or t
  modified_base (431)..(431): a, c, t, g, unknown or other
  misc_feature (431)..(431): n is a, c, g, or t
  modified_base (797)..(797): a, c, t, g, unknown or other
  misc_feature (797)..(797): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcgagggcacgagggtcctgggcccagtctcgccctgactcgacgcctcgcctcgtgtcgtcggtcctccgtaggacngtcgactcaacctctcctccgtagacctaaccgtaccggaacccgtgtagtacggtacggttggtacttaactttaactttaacttagttcggttacggtttaccggaaccgaacgaaccggaacccgtaaggtccctaacgtacccgtaacccctaaacttctttaactttctttagacgtagtacgtactaagtacccgtccggtacccgttgggtttacngttacgttccgtattcgtcggtccgtaacctcgtaacgttccgaccgtacccgaccgtcccgtccttaccacgtaaccgtacgtcccgggtacctaccaccggtacgtacgggacggacggtacggtacttagtttaacgttaagttttaagtacgtttacggttaaacttataaaccgtaaccgttaaacccggtaactcgggttaaccctaacgggggttttcggtcggggtttaacgggacggggaccggtaccgtagtccggtaaccggtaccgtccgttaccggtacgccggtaacccgaccggtccgtacccggttcccccgacgttcgtacctcccggttaccgtacccccggttcccncgtaacccg

SEQ ID NO: 274468 - DNA, 806 bp, Homo sapiens
  misc_feature: GYAE6OF01COKNG.27.23.C01.1.454.CMB.1.raw
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatctcctgcacgtcggaacccgngatgacggtttggtcgtacttattaactttntcgttggttacggtaccgaagacggacccaggtccacgtccgtaaccccaatcgtatttctttatcgtattcgtactaacgttaacgtccccgggtccccgttaaggggttttccagtacgttccggtcttacgtacgtcggtccttactaacggttcctacgcccgtacgaccggttcccctacccgtagtacccttaccgttcccggtcccgggtcctaccggtacgtaccccgttaggggaacgggtacccggaacgggttccttaaggttaaacttttacgttttaacgggttacgtttaacgttaacctaaacgttaaccttaacccgaacgtagttacgtacccgtttaggggtttcgggttacgggttaccggggaacgggtacggtaacccggtcggggtaccgttaaccgggtccccgttaaccgggtaacggacccgtaccggtacccgggaaccggttccggacccccgtaccccgttcggtaacccgttacccgtcccgtttaccccgttcccccgtcccgttacccgg

SEQ ID NO: 274469 - DNA, 805 bp, Homo sapiens
  misc_feature: GYAE6OF01EIGN9.27.23.C01.1.454.CMB.1.raw
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctcgccctgactcagcctcgcctcgtgtcgtggtctccgtggacagtcgactcaccatcctcctgcacgtacggaacccgngatgtacgttggtntactttaataactttntcttggttacgtaccgacgacggacccaggcctacgtccgtacccctaaatctatttcttagtgtatcgtacaacggttaacctcccggggtaccccgttagggttttcaggtacttccgttcttacgtagtcgtacctaccgtagttccgtacgaccccgtaccggacccggtcccctacccgtacgtacctaccgtcccggtaccggcctacccgacgtccgtagggacggacggtacgtcgttacgttaatttacgtttacgtttacggttaacttacctaacgttaaacgtaaacccgtaacgttacggtacgtaaaccggtttacggggtttcggggttaccgggttacggggaaccggggtaaccgggtacccggtacgggttacccgttacggtaaccccgttccgttaacggttaccggaacccgtaccggtaacccggtaacccggtccccgttacccccggttccccggttacccggttaccttacccgtttccccggttaccccggttcccccgttaacccccg

SEQ ID NO: 274470 - DNA, 753 bp, Homo sapiens
  misc_feature: GYAE6OF01EM7XY.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctcgccctgactcagcctgcctcgtgtctgggtctcctggacagtcgatcaccatctctgacacgtacggaacccgcgatggtacggttgggtcgtacttttaaacttaacttttactcgttggttacggtaacccgtaacgaaccgggtaacccgaggacctaccgttaccgtaccccctaaacttcctacttttactttagtgtagttcgtacgtaacgttaaccgtcccgggtaccccgttagggtttcctgtacgttcgtctttacctagtcggtacctacgtaacgttcgtacgtacccgtaccgaccggtccctacccgtacgtaccctacgtcccggtcccgggtcctaccgacggtccgtaggacgggacgtacggtacgttagttatttaagtttacgtttacgttacgtactaagttacctaaaccgtaacgtagtacgtaacgtttacgggttgggttcggtccgggacgggtaccggacgtacggcgtaccgtaccgtaccgtacggaccggacgtacccgacggtccccgtcccgtccccgtccgtaccttaccgttaccgttcccgttccccgtccgtacccg

SEQ ID NO: 274471 - DNA, 981 bp, Homo sapiens
  misc_feature: GYAE6OF01EQ6K7.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtcggaacccgngatgacgttggngtactttaatacttttntcgttgttcggtaccgacgacggaccaggcactcgtaccccaactctatttcttatgtattcgtactacgttaacgtcccgggtaccccggttaggggtttcctacgtacgttccgtaccttttacgtacggttcggtaccttaccgtaaacgttccgtaccgtacccgtaaccgtccccggtacccctttacccgtaccgtaaccccgtacgtttcccccgggtacccgggtacccttacccggaaccggttaccccggttaacgggggaaccggggtaacccgggttaacggggttacccgtttaagggttttaaacgttttttaaaccggtttttacgggtttttaacgggttttaaacggtttttacctaaaacggtttaaaccttaaacccgttaaaccccggttaagggtttaaccgtaaacccgggttttaaccggggtttttacggggggtttaccgggggtttacccgggggaaccggggggtaaaccgggggttaaccccggtaaccgggggttcccgttaacccgggggttaaccccggtttacccgggttaaaccggggttaccccgaaaccggggttaaaccccccggttaacgggggtccccccgtttacccccggggtcccccccgtttaaccggggttacccctttaccccggtttttaccccccggttaaccccccggttacccccttacccgggtaaaccccg

SEQ ID NO: 274472 - DNA, 669 bp, Homo sapiens
  misc_feature: GYAE6OF01ESIDJ.27.23.C01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (658)..(658): a, c, t, g, unknown or other
  misc_feature (658)..(658): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccccgngatcgacgttggngtctttaataacttttatctgttcggtaccgacacggtacccaggcactcgtacccccaaatctactttctttaatgtatcgtctagtaactccggccccgtaggggtttctgatcgtcttctatcggctacagtctgcctacaccgcctcccgcgtaccacgtccgtaccgggtccctccgacgtaccgtggtaacgggacgtaaggccttaggtacttttaagttttacgttagtttagtacctaattacgtaaacaaccgtgtagaccgtacgtttcgggtggttaccgggacgggtacgggaccgtaggccgtacggtacccggttccgtacgggttaccaccggtcccgaaaggccgttacccgtccccccgttcgggtacccaccgtttcctacccggtttcccccnccccgtacccg

SEQ ID NO: 274473 - DNA, 723 bp, Homo sapiens
  misc_feature: GYAE6OF01APR85.27.23.C01.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaaccccgngatgacgtttggngtctttaataacttttatcgttgttcggtaccgacgacggacccaggccacttcgtacccccaaactctatttctttatgatcgtactaagtaacgtcccggtcccccggtaggggtttcctgtactcgtcttctagtcgcctaccgtaagtccgtcgtaccctaccgaccggtccctccctcgacctacgttcccgtcccgggtcctccgacgtccgtacggacggacggagtcgttagttaatttacttagtttacgttacgtttactacttaactaaccaaccgtagtacgtaacgttacggtttggggttacgggttaccgggacggggtacggtaccgtcgggtcccgtacgggtacccgttccgtaccgggtaccgccggtaaccccggagggttccccgtaccccggtcccccgttaccggtcccttacccggttccccgttccccggttccccccgccccgttcccgg

SEQ ID NO: 274474 - DNA, 698 bp, Homo sapiens
  misc_feature: GYAE6OF01D4L1S.27.23.C01.1.454.CMB.1.raw
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactcgggaaccccngatggacgtttggtntactttaataacttttntcttgttggtaccgacacggacccaggcactcgtaccccaactctatttctttatgtattgtcaagtaacgtcccggaccccgttaggggtttctgtactcgtcttctagtcggctaccgaagttcgtcgtacccgtaccgaccggtccctacccgtacgaccctacgtccgtccgggcctccgacgtcccgtagggacggacgacggtcgtagtaatttagttagtttagttagttctattactacaacctagtacgacgttacggtttgggttacgggttccgggacggggacgggaccgacgggtccgtaccgggtacccgttaccgttacgggtaccgaaccggtacccgaacggtcccgtaccccggtcccccggttcggttacccctaccgttaccgtttccccgttacccccgtaccccttaccccg

SEQ ID NO: 274475 - DNA, 825 bp, Homo sapiens
  misc_feature: GYAE6OF01CXZXQ.27.23.C01.1.454.CMB.1.raw
  modified_base (217)..(217): a, c, t, g, unknown or other
  misc_feature (217)..(217): n is a, c, g, or t
  modified_base (301)..(301): a, c, t, g, unknown or other
  misc_feature (301)..(301): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcgagggcacgacgggtcctgggcccagtctcgccctgacctcacgcctcgcctccgtgtctcgggtctccgtggacacgtcgacnccacctactcctcctgaccgtacgtaccgggaacccgcgtaacgttcgggtaccgtttgggtcgtacttttaacttaacttttntcgttaggttaccggtaccgacggaaccggtacccgacggacctaccgtacccgttaacccaaacttcttactttccgtttatgtacttgtacgtaacgttaccggtcccggtacccggttaggtttcacgtacttccgtacttcgtacgtcgtacctacgtaacgttcccgtactacccgtaccgtacccgtccccgttccaccgtaccgttaccgttcccggtcccggaccgtacccgtacggtaccgggtcgggaacgtcggacggtttacctaagtttaacgttttagttagtttacgttacgttaactaacgtaacgtaaccgaacggttcgtaacgtccgggttaagggtttccgggttcggtaccgggaacggggtacggtacccgtaggtcccggtaaccgttaccggtacccggttaggacccgacccggacccgggttacctcccggtacccccggtcccgttaaccgtccttaacccggttccccaacccggtttcccccacccggtaacccg

SEQ ID NO: 274476 - DNA, 705 bp, Homo sapiens
  misc_feature: GYAE6OF01COF51.27.23.C01.1.454.CMB.1.raw
  modified_base (257)..(257): a, c, t, g, unknown or other
  misc_feature (257)..(257): n is a, c, g, or t
  modified_base (337)..(337): a, c, t, g, unknown or other
  misc_feature (337)..(337): n is a, c, g, or t
  modified_base (494)..(494): a, c, t, g, unknown or other
  misc_feature (494)..(494): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgacctcagcctgccctccgtggtctgggtctccgtggacagtcgactcaccatctcctgcacgtcggaacccgcgatggtacggttgggtntactttaattaactttagtcttggttacgtaacccgacgacggacccaggcctactacgacccctaaatctatttcttangtatcgtacagtacgtccggacccggttaggttctagactccgtcttctagtcgacctacgtagtccgtacgcctacgccgtccctacctacggtaaccctcgtcccgtccggtctccgacgtccggtaggacgggacgtacgtcttacgtaatttnttacgttagttacgtataactaacgttaaccaacgttagtacgaaccgttagggttgggttccggtacggggacgggtaacgggacgtacggtcgtacccgggtaccgttcgggtacgtacccggaaacggtcccgtaacgggcccctaccccggtcccccgttacggtcccgtaccgtttccgttaccccgtccccgtaccccgtacccg

SEQ ID NO: 274477 - DNA, 663 bp, Homo sapiens
  misc_feature: GYAE6OF01CZ207.27.23.C01.1.454.CMB.1.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (318)..(318): a, c, t, g, unknown or other
  misc_feature (318)..(318): n is a, c, g, or t
  modified_base (350)..(350): a, c, t, g, unknown or other
  misc_feature (350)..(350): n is a, c, g, or t
tcagagcgtcgtctcacgaccggtgctcgatttagtacacgtgattagggagttgggggggggtctcaggaggcagcgctcgtcgggacgtctccaccatggcctgggctctgctattcctcaccctctcactcagggcacagggtcctggcccagtctgccctgactcagcctgcctcgtgtctgggtctccgtggacagtcgatccaccatcctcctgcacgtcggaaccccngatgacgttggtntcttaatactttatcttggttacggtaccgacgacggacccaggcactcgtacccaaatctattctttangtatgtacagtacgtccggccctagggtttcngacgtcgtcttctagtcgtctacgagtctacgtcctacgaccgtccctccgtacgacctacgtcccggtccgggtcctaccggtacgtcccgtagggaacggtaccgggaggtcgttagttatttagtttagttcgttacgttactataactaaccgtaacgtgtacgtaacgttacgggtttcgggtcgtcgggaccgggtacggaccgtagggtccgacggtacccgtacggtacggaccgacggtacccgaagggtccctccggtaccccggttcgtacctccttccgtttccctcccgtcccttaccgg

SEQ ID NO: 274478 - DNA, 849 bp, Homo sapiens
  misc_feature: GYAE6OF01D30OM.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacagggtcctgggcccagtctcgccctgactcagcctgcctccgtgtctggtctccgtggacagtcatcaccatctctgctacgtcggaacccngatcgacgtttggcgtacttaattaacgtttattcgttgttacggtaaccgtacgacgggtaacccaggtcctacgtccgtacccctaaaacgttcctacttttactttaagtcgtacgttgttacaaggttaaccgtcccgggtacccccgttaaggggtttttcctacggtacttccgtcttttcgtaacgtcgggtacccttacgtaaagttcccgtcggtacccttaaccgggtacccgtcccttccccgttaagaccccgttaacgttcccgtacccggggtccttacccgaacgttccggtaacgggacgggtacgaaacggggttcttaggttaaacttttaggtttaagtttacggtttaacgtttaaccctaagtttaacccttaaacccgaaacggttaggttaacgaaccggtttacgggttaagggtttcgggttaccggggacggttaacggggaaccgttcgggaccgttaccgggtaacccgggtcgttaaacggggtcccaaaccgggtaccccgtaagggttccccgaaccccgggttcccccgttcggtttaccctaaccgtttcccggtttaccccgtaccccccgttcccgtaacccg

SEQ ID NO: 274479 - DNA, 666 bp, Homo sapiens
  misc_feature: GYAE6OF01BCYUQ.27.23.C01.1.454.CMB.1.raw
  modified_base (266)..(266): a, c, t, g, unknown or other
  misc_feature (266)..(266): n is a, c, g, or t
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
  modified_base (443)..(443): a, c, t, g, unknown or other
  misc_feature (443)..(443): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtcgggaacccgcgatgacggttggtgtactttaattaactttntcttgttcggtaccgacgacggacccaggcactcgtaccccaaatctatttctttangtatgtctagtactccggaccccgtagggtttcngtactcgtcttcgtgtcggtcctacgaacgtcctgccccgtacacccggtccctaccgtcgacctacgtcccggtcccggactccncggtccgtcggacggacgcgtctaggttactttatttagttcgttagttactacgttaactaaccaacgtgtacgtacgttacgggtttgggtacggtccgggacggggacggtaccggaggtccgtacggtacccgttccgtaaggcccgaacggcccgtaacggtcccgttcccggccccgttcggtccctactttaccgccccttaccctccccgtaccg

SEQ ID NO: 274480 - DNA, 720 bp, Homo sapiens
  misc_feature: GYAE6OF01BEM01.27.23.C01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaacccngatgacgttggtncttataactttatctgttggtaccgacaggacccaggcactcgtaccccaaactctatttctttatgtatcgtacagtaactccggccccgtagggtttctgtatcgtcttctagtcggcctacgaagttctcgacctacgaccggtccctcccgtagacctacgtccgtcccgggcctccgacgtcccgtaggacggtacgacggtctagtaactttagttagtttgttagttactaagttacgtaacctaaccgtagttacgtaaccgttaacgggtttcggggttacgggttaccggggtacgggtaaccgggtaacccgtacgggtaccgttaccgggtaccccggttaccggttaacgggtaccgtaaccgggtaccccggtaaacgggtcccgtaccccggttacccccccggtacgggttaccctacccgtttacccgttcccgggtttaccccccgtcccccttaacccgg

SEQ ID NO: 274481 - DNA, 741 bp, Homo sapiens
  misc_feature: GYAE6OF01AYN2F.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgccctccgtgtctgggtctcctggacagtcgatcaccatcctcctgcacgtcggaacccgcgatggacgttggtgtctttaatactttatcgtgttcgtaccgacgacggaccaggctactcgtaccccaactctactttctttatgtatgtcgagtaactccggtccccgtaggggtttctagtactcgtcttcgtagtcggtactacctaagtccgtcgaccctaaccgaccggtccctccctcgtaccctacgttcccggtcccgggtcctccgtacgtcccgtagggaacgggtacggacggtacgttacggttaaattttaacttttagtttaggttaactttaactaagtaacgtaaccgtaacctacgttacggtaaccttacgggttttcggggtacgggtttccgggacggggtaacgggaaccggtacggtaccgtcggtaacccgttccggtaacggtccggtacggaaccccgtacgggtcccttaccccgggtcccccgttccggtacccttacccggtccttttaacccccgtccccccgtaacccgttccccg

SEQ ID NO: 274482 - DNA, 742 bp, Homo sapiens
  misc_feature: GYAE6OF01A16DK.27.23.C01.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (275)..(275): a, c, t, g, unknown or other
  misc_feature (275)..(275): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacngtcgatcaccatcctcctgcacgtcgggaacccncgatggtacggtttgggtgtactttaattaaacttttntcttggttcggtaaccggacgacggacccgaggccactccgtacccctaatctatttctttagtgtatgtacgtagtacgtcccggccccgtagggttctgtactcgtcttctagtcgcctcagtctagccctacgtccgccctcctcacctcgtccgtccggtctaccgcgtcgtacggacggtacggacgtcgttagtattttaacgttacgttaggtttaacttactaagttaacctaacccgtaacgtaagtacgtaaccggttcgggtttcggggttacggttaccggggtacggggacggtaccggtaacgggtccgtaccggtacccggttacggtaaccggttccgaaccggtaccccggtaacgggtcccccgttaccccgggtaccccccggttccgggttaacccttccccggttaccccggtttcccggttcccccccgttccccgttaccccgg

SEQ ID NO: 274483 - DNA, 789 bp, Homo sapiens
  misc_feature: GYAE6OF01C8MV7.27.23.C01.1.454.CMB.1.raw
tcagagcgtcgtctcacgaccggtgctcgatttagtacacgtgattagggattgggggggggtctcaggaggcagcgctctcgggacgtctccaccatggcctggctctgctattcctcaccctcctcactcagggcacagggtcctgggcccagtctcgccctgactcgacgcctgcctccgtgtctgggtctccgtggacagtcatcactatctcctgacacgtacggaacccgcgacttgtaccggtttggtcttactttaattaacgtttatcgttggttaccggtaaccgacgaccggaccgaggacctaccgtaccgtaacccctaaactcttacttttacgtttatgtacgttgtactaacggttaaccgtcccgggtacccccggttaggggttttccagtacgtaccgttcttacgtacgtcgaccttaccgtaacgtccgttacgaacccttaccgacccggttccctcccgtaccgtacctaccgtttaccggtcccgggtcctaccggtacgtcccggtaggaaacgggacgggtcggttaacgttacggtttaaatttaacgttttaaggttacgtttaacgttacgtaacttaacgtaacctaacgtacggtacgtaacgttacgggttcgggttacgggttaccgggaacgggacgggtacccgggtagtacccgtacggtacccggttaccgttaaccgaccgaaccggacccgtacggtcccgtcccgtccccgtcgtacctccgttactccccggtccctacccgtacccg

SEQ ID NO: 274484 - DNA, 771 bp, Homo sapiens
  misc_feature: GYAE6OF01C4O06.27.23.C01.1.454.CMB.1.raw
  modified_base (92)..(92): a, c, t, g, unknown or other
  misc_feature (92)..(92): n is a, c, g, or t
tcagagcgtcgtctcacgaccggtgctcgatttagtacacgtgattagggagttgggggggggtctcaggaggcagcgctctcgggacgtcnccacatggcctggctctgctattcctcaccctctcactcgagggcacgagggtcctggcccagtctcgccctgactcacgcctcgcctccgtgtcgtcgggtctccgtaggacagtcgactccaaccgtctccttccacgcctaaccgtaccgggaacccgcggtaagtcggtacggtttggtataccttttaatttaacgtttatcgttaggttacggaccgagaccggaccaggcctactacccgtacccaaacttctatttacgtttatagtatgtacgtaacgttaccgtcccggtacccggttagggtttactcgtactcgttctttacgagttcggtacctacgtaacgtcctacgtacctaaccgtccgtccctacgtaccgacctaccgttccgaccgggtcctaccgacggtacctagggaacggtacggtagttacgttaagtttaagtttaagtttacgtttacggttaagtttacctaacgtaacttaaccgaacgtagttaacgtaacggtttcgggtttaggggtacggtcgggaacgggttacggacgtcggtaccggtaccgtacggtccgtaggcctaaaccgggacccttacgggtcccctacccggtcccgttacgtaccgttaccccgtccgtttaccccgcccccgttacgtacccgg

SEQ ID NO: 274485 - DNA, 684 bp, Homo sapiens
  misc_feature: GYAE6OF01DVK5E.27.23.C01.1.454.CMB.1.raw
  modified_base (229)..(229): a, c, t, g, unknown or other
  misc_feature (229)..(229): n is a, c, g, or t
  modified_base (345)..(345): a, c, t, g, unknown or other
  misc_feature (345)..(345): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaacccgngatgacgttggtgcttatactttatcttgttggtaccgacgacggacccaggcactcgtaccccaaactctatttctttaatgtatgtacagtacgtccggccccgtagggtttcngactcgcttctatcggctccgtaagtcctgaccctacgaccggtccctcccgtagacctacgttccgtcccgggtctaccgacgtcccgtaggacgggaacgaggtcctagtaatttatttagttgttacgttctaacttaagtaacctaaccgtagtacgaacgttaacggtttcggggttacggtttccggggacgggaacggtaccgtagggtctaccggtacccggttccgtaacggtaccgacggtaccccgtaaggggtccctccggtacccccccgttacgggtacccttaacccgttcccgtttacccgttccccctaaccccgttacccg

SEQ ID NO: 274486 - DNA, 694 bp, Homo sapiens
  misc_feature: GYAE6OF01DXUTB.27.23.C01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (500)..(500): a, c, t, g, unknown or other
  misc_feature (500)..(500): n is a, c, g, or t
tcagagcgtcgtctcacgaccggtgctcgatttagtacacgtgattagggagttggggggggtctcaaggaggcagcgctctcgggacgtctccaccatggcctggctctgctattcctcaccctcctcactcgagggcacgagggtccctgggcccagtctcgccctgactcagcctgcctcgtgtctgggtctcctggacngtcgatccaccatcctcctgccacgtcggaaccccgngaatggtacgttgggtntctttaattaactttatcttggttacggtaccgacgacggacccaggacctactccgtaccccaaactctatttctttatcgtatcgtacaagtaacgtcccgggtaccccgtaggggtttctagtactccgttcttcctaagttcggaccttaccgtaagtcctcgacccttacgacccggtccctacccgtcgaccctacgtcccggtaccggtctccgacgtccgtaggacgacgcggtntagtattacgttattgtacgtactagtactaacgaactagtcaacgttggttgggttacgtcgggacgggtaaccgacgtacggtcgtaccgtaccgtaccggtacgtccgtaaccggaccgttaacgggccctcccggtcccccgttacgtaccgtacccgttcccgttacccggttcccccgtccctaccgg

SEQ ID NO: 274487 - DNA, 727 bp, Homo sapiens
  misc_feature: GYAE6OF01A04RH.27.23.C01.1.454.CMB.1.raw
  modified_base (326)..(326): a, c, t, g, unknown or other
  misc_feature (326)..(326): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatctctgcacgtcggaacccgcgatcggacgttggtcgtactttattaactttatcttgttacggtaccgacacggacccaggaccacttcgtaccccaaactctatttctttangtatcgtactagtacgtccggcccggttggttctgtacgtcgttcttactacgtcggtcctacgtacgtccgtcgtacccgtaccggacccgtacccccgtacccaccgtaccggtcccgtcccgggaccctaccgaccgtccgtacgggacggaccggacggttctagttaactttacgtttagttcgttaattactaacttaacgaaccctaacgtacggttacgtaacggttcgggtttacggggtcggttaccggggtacgggacgggtaccgagggttcgtacccggttaaccggtccgtaaccggtaccgaccggtcccggtaacggcccgtccccggtccccgttcggtacctaccggttcccgttcccgttaccccgtccccttcggaacccg

SEQ ID NO: 274488 - DNA, 762 bp, Homo sapiens
  misc_feature: GYAE6OF01B8SNR.27.23.C01.1.454.CMB.1.raw
  modified_base (248)..(248): a, c, t, g, unknown or other
  misc_feature (248)..(248): n is a, c, g, or t
  modified_base (377)..(377): a, c, t, g, unknown or other
  misc_feature (377)..(377): n is a, c, g, or t
  modified_base (510)..(510): a, c, t, g, unknown or other
  misc_feature (510)..(510): n is a, c, g, or t
  modified_base (747)..(747): a, c, t, g, unknown or other
  misc_feature (747)..(747): n is a, c, g, or t
tcagagcgtcgtctcacgaccggtgctcgatttagtacacgtgattagggagttggggggggtctcaggaggcagcgctcgtcgggacgtctccaccatggcctgggctctgctattcctcaccctcctcactcgagggcacgacgggtcctcgggcccagtctcgccctgactcagcctgcctcgtgtcgtgggtcctcgtggactacgtcgactccacctatcctccgagcgacgtacggacccgngtagtggtacggtttggtacgttactttaacttaacttttcgtcgttacggttaccggaaccgacggaaccggtaccgacggtcctacccgtaccgtaaccccctaaattcttaacgtttactttaagngtacgttacgtaacgtaacgttacccggtcccggtacccgggttagggtttcacgtacgtcgttccttacgtacggtcgtaccttaacgtacggtccgtacccaccgtaccggtaccccgtccctaccgtacnccgtaccgtcccgggttacccgcctaccgacgtccggtaacggacggtacgtacggtagttacgttaatttagttacgttagttactactaataaccgtaacacgtacggtacgtacggttaggttcggggttacggtacgggacgggtacgaccgtgtaccgtaccgtaccgtcggacgaccgtccggacctacggtccccgccgtccccgtaggtccctacgttcccggttcccnccccgtacttaccgg

SEQ ID NO: 274489 - DNA, 882 bp, Homo sapiens
  misc_feature: GYAE6OF01AW7IK.27.23.C01.1.454.CMB.1.raw
  modified_base (243)..(243): a, c, t, g, unknown or other
  misc_feature (243)..(243): n is a, c, g, or t
tcagagcgtcgtctcacgaccggtgctcgatttagtacacgtgattagggagttgggggggggtcgtcaggaggcagcgctctcgggacgtctccaccatggcctggctctgctattcctcaccctctcactcagggcacgagggtcctgggcccagtctgccctgactcagcctgcctccgtgtctgggtctcctggacagtcgatccaccgtatcctcctgaccacgtcgggaaaccccgngtaagtcggtacggtttgggtgttccttttaattaacctttttatcgttacggtttcggtaaccgacgaaccggaccgacggcctacgtcgtaccccaaactcttactttcctttaagtagtacgtcgtaccgtaggttaaccgtcccgggtcccccgttaggggtttcctgtacgtcgttaccttcttagtccggtacctaccggtagtcctcgtacccgtaccggaccgttcccctaccgtaccgtaccctccgttccggtccccgggtaccttacccgacgggtacccttacgggggaccgggtaacggtcccggtagttacggtttaactttaacggttttcgttagttacgtttaaccgtactttaagtacccgtaacgtgttaacccggtaggttacggtttacggggggttcgttaccggggggtacgtaaccgggggaccttaccggtacgggttacccggtacccgggtttacccgggtaacggggttccccgaaaccccggggttaccccggaaagggggtttcccccctaccccgggttacccccccggggtttacgtttaaacccccgcccggtttttaccccccggtaccccggttttccccccccgttaaaccccgtcccccggg

SEQ ID NO: 274490 - DNA, 856 bp, Homo sapiens
  misc_feature: GYAE6OF01AI7DB.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattgggggggggtctcaggaggcagcgctctcgggacgtctccaccatggcctggctctgctattcctcaccctcctcactcagggcacagggtcctgggcccagtctcgccctgactcagcctgcctccgtgtctggtctcctgacagtcgatcaccatcctcctgcacgtcggaacccgngatggtacgttggtgtactttaattaacttttatcttggttacggtacccgaagacggaccccaggccacttaccgaccccctaaactcgtaatttctttagtgtagttcgtactaaggttaaccgtccccgggtaccccgttaggggtttcctagtacgttccgtcttactaggtcggtcctaccgtaacggttcctaccgtacccgttaacccgaccggttccccctaccccgtacgtaacccctacgttccccgggtcccgggtaccctacccgtacggtcccgtaggggaaccgggtaccggtaggtccgttaagttaacgttttaattttacgtttacggtttaacttaccttaattaaccgtaacctaacggtacgttaccggtaaaccgtttccgggtttgggggttacccgggttaccgggggtacgggtaacccgggggaccgtaacgggtccccggttaaccgggttaccccgggttaccggttaacgggtaccccggaaccccggtaccccggttaaccgggtccccgttacccccgggtacccccccgtttcggtaaccccgttcccgtttccccgttcccccggtttcccccccggtccccttaccccggg

SEQ ID NO: 274491 - DNA, 723 bp, Homo sapiens
  misc_feature: GYAE6OF01A7LZI.27.23.C01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcgggaaccccgngaatcggtacgtttggcgtacctttaattaaccttttatcgttggttcggtaccgtacacggacccgaggcactcgtacccaaactcattctttatgtatgtcagtaactccggccccgtagggttctgactcgtcttctgtagcgtccaacgttcgtacgtaccctaccgaccggtccctcccgtacgtacctacgtcccgtaccgggtccttccgacgtcccgtaggacggacggtaggtcctagttaagtttacttagttaggtacttcgtaacttaacgtaacctaaccgtagttagaacccgttaggtttacggggttccgggttaggggacccgggtaggggtaaccgtcggggtaccgtcgggttacccgtaccgggttaaccggtaccgtacgggtacccggacggtccccggttccccgaccccggttccgtaccgtacccgttcccggttcccgttacccccgtccccgttaacccgg

SEQ ID NO: 274492 - DNA, 677 bp, Homo sapiens
  misc_feature: GYAE6OF01CP45C.27.23.C01.1.454.CMB.1.raw
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (373)..(373): a, c, t, g, unknown or other
  misc_feature (373)..(373): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctcgccctgactcagcctgcctccgtgtctgggtctccgtggacagtcgatccaccatcctcctgccacgtcggaacccgngtatgtacgttggtcgtctttaattaactttntcgttggttacggtaccgacgtacggaccaggccactccgtacccctaactctatttactttatgatcgtacacgtaacgtccggccccgttagggtttcngtactcgtcttctcgtcgtcctacgtaacgtctccgacctaccgccgtccctcctacgacctccgtccgtaccggtccgtccgaccgtccgtacggacggacggacggtacgttacgttattacgtttagttacgttagttacgtattaactactacgtaaaaacgtcgtacgtacggttacgggttcgggtacgggtacgggacggacggtacggtacgtcggtaccgtcgtacggtcgaccggacgaccggtccgtcccgtcccgtccgtcctccgttccgtcccgttcccgtcccgtcccg

SEQ ID NO: 274493 - DNA, 804 bp, Homo sapiens
  misc_feature: GYAE6OF01DZUKP.27.23.C01.1.454.CMB.1.raw
  modified_base (250)..(250): a, c, t, g, unknown or other
  misc_feature (250)..(250): n is a, c, g, or t
tcagagcgtcgtctcacgaccggtgctcgatttagtacacgtgattagggagttgggggggggtctcaggaggcagcgctcgtcgggacgtcctccaccatggcctggctctgctattcctcaccctcctcactcagggcacgagggtcctgggcccagtctcgccctgactcacgcctgccttcgtgttcgtggtctccgtggacagtcgactcgacctactccttccgtgaccacgtacggaacccgngtagtcggtacggttggtactaacttttaagttaactttgttccgttggtttacggtaaccgacgaaccggaacccgacggactaccgtaccgtacccctaaaacttcctttaattttacgttttagtagtaacgttcgttaccgtaacggttaaccggttccccgggtacccggtttacgggtttctacggtactccgttcttcgtacgtcgtaccgtactaacgtctaccgtacccgtaacgacccggtccctacccgtctaacccgttcgtcccggttaccggtaccctccggacgtacccggtagggtaacgggacggagttaacgtagtttatttacgtttagtttacgtacgttactaaagttactaacgtaacgtacgtagtacgttaggttacggttggttaccgggacgggtacgtacggtacggtccgttacggtaccccgtacggttaggaccccggaccggtacccgtacgggtccccttaccccgggtcccgttacccggttccgtaccgttcccctttaccccgtccccgtccgtacccg

SEQ ID NO: 274494 - DNA, 806 bp, Homo sapiens
  misc_feature: GYAE6OF01DOWQA.27.23.C01.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctggcccagtctgccctgactcagcctgcctcgtgtctgggtctcctggacngtcgatcaccatctcctgcacgtcggaacccgngatgacgttggtgtcttataacttatcttgttcggtaccgacacggacccaggcactcgtacccaaactctattctttactagtattgtcgtaagtaacgttccggtccccggttaggggttttccgtacgtacgtccggtctttactacgttcggtccgttaccgtaacggtcctaccggtacccgttaacccgacccggtccccttccccgtacgtaaccctacgttcccggttaccccgggtcccttacccgacgtaccccgtacggggtaaccgggaaaccggtacggggtacttaggttaatttacgttttagtttacgtttacggttactaacttaacgttaacctaaccgtaacgttcgtaaacgttaccggtttacgggtttgggttaccggggacgggtaaccggggaaccggtacgggtaccggttaccggtacccgttaccgggttaaccgggtaccggtaacccggtacccggtaaccgggtcccggttccccggtaccccccgttaccggtacccttacccgttcccgttccccggtttcccccgtcccggtttaacccccg

SEQ ID NO: 274495 - DNA, 827 bp, Homo sapiens
  misc_feature: GYAE6OF01D25PR.27.23.C01.1.454.CMB.1.raw
  modified_base (284)..(284): a, c, t, g, unknown or other
  misc_feature (284)..(284): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcacctatcctcctgacctacgtacgggaacccgcgtagttcggtacggtttgggtcgtacttttaattaacttttntcgttggtttacggtaccgacgtacggacccagggacctactcgtacccctaaactcttactttacgtttatgtattagtctaacggtaacgtccccgggtaccccgttaggggttttctacggtaacttccggttcctttaccgtaacggttccggtaaccttacccgtaaacggtttccgtaccgtaccccgttaaacccggacccggttcccccgttacccgtaacccggtaacccgtaccgtttcccgggtaccccgggttacctacccggtaccggtccgtaacgggaaccgggtaaccgggtacggttacgttaacggtttaactttaagtttaacgtttacggttaacggtttactaaacttaacctaaccgtaaacgtagtaccggtacgtacgggttcgggttacgggtcgggacgggtaggaccgtggtaccgtacggtaccggtaccgttacggcgtaccgaccggtaaccggtccgtcccggtcccccgtcgtacctaccgttccgttcccgttccccgcccttaccccgg

SEQ ID NO: 274496 - DNA, 974 bp, Homo sapiens
  misc_feature: GYAE6OF01A150W.27.23.C01.1.454.CMB.1.raw
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
  modified_base (336)..(336): a, c, t, g, unknown or other
  misc_feature (336)..(336): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctcgccctgactcagcctgccctcgtgtctgggtctctggacagtcgatccactatcctctgcacgtcggaacccngtatggtacgttggtgtacctttaataactttntcgttggttacggtaccacgacggaccgacggcctacgtccgtaccccaacttcctaactttcttttacgngtagttcgtacgttaaacgtaaccgtcccgggtaccccccggtttaggggttttccgtacggttaacgttccgttccgtttaccgttaggtccggtacccttaccggtaacgttccgtaccgtacccgtacccggtaccccggtaccccgtttccccgtaccgggtaaccccttacggtttaccccccggggtacccgggtacccgtacccccggtaaccggttacccggtaaccgggggttaaccggggaaccgggtaacggggttacccgtttaagggtttaaaccgttttttaaacgggtttttaaccgtttttaagggttttaaacccttttaaccgtaaaacccttttaaacccggtaaaccgttaaaccggttaaacgttaaccgggttaaccggtttaccggggttttacgggggtacgggggttttaccccggggaacggggttaacgggtaacccggaacgggttcccggtacgggttaccccgtttaccgggaaacccggggttcccgaaccgggtacccccgtaaacggggtcccccgttaccccccgggttacccccggtacccggttaccccggttaccctttaccccggtttaccccccgttaccccccgtccccggtaccccg

SEQ ID NO: 274497 - DNA, 773 bp, Homo sapiens
  misc_feature: GYAE6OF01D4LLZ.27.23.C01.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaacccngatgacgttggntcttataactttatctgttggtaccgacgacggaccaggcactcgtacccaaactctatttctttatgatgtacagtaacgtccggaccccgtagggtttctgtactcgtcttcgtagtcggtacctaccgtaacgttctacgtaccccgtaacgacccggtcccttacccgtacgtaacccgtacgttcccggttacccgggtcctacccgtacggtacccgttacgggaacgggtaaccggtaacggtccttaaggttaacttttaacttttaacggttttaacggtttaacgtttaacgtaaacgtttaaccgttaaacccgtaaaccgtaggtacgttaaccgttagggtttacggggttacgggttaccggggaccggggtaacgggtacccgaggggtaccctacgggtaccccggttaccggtaacgggtacccgaaccggtaccccggaaacggtcccgtaccccggtcccccgttacgggttcccacccgtttccgtttccccggttcccccgtcccttacccg

SEQ ID NO: 274498 - DNA, 774 bp, Homo sapiens
  misc_feature: GYAE6OF01CWUPI.27.23.C01.1.454.CMB.1.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
  modified_base (387)..(387): a, c, t, g, unknown or other
  misc_feature (387)..(387): n is a, c, g, or t
  modified_base (436)..(436): a, c, t, g, unknown or other
  misc_feature (436)..(436): n is a, c, g, or t
  modified_base (583)..(583): a, c, t, g, unknown or other
  misc_feature (583)..(583): n is a, c, g, or t
  modified_base (738)..(738): a, c, t, g, unknown or other
  misc_feature (738)..(738): n is a, c, g, or t
  modified_base (761)..(761): a, c, t, g, unknown or other
  misc_feature (761)..(761): n is a, c, g, or t
tcagagcgtcgtctcacgaccggtgctcgatttagtacacgtgattagggagttggggggggtctcaggaggcagcgctctcgggacgtctccaccatggcctgggctctgcttattcctccaccctcctcactcagggcacgacgggtcctcgggcccagtctcgccctgactcacgcctcgcctccgtgtcgtggtctccgtggacngtcgactccacctatcctcctcgacctacgtccggaacccgngtaacgtcggtacgtttgggtacttacttttaactttaacttttcgttcgttggttaccggaacccgaacggaaccggacccgaggcctaccgtaccgtaacccctaaattctttaacttttacgttatacggttnttacgtacgtaacggttaaccgtccccggtacccggtttaagggtttcncgttaccttccgtttactttaacgtagtccggtacctaacgttcgtaccgtaccgacccgttaaaccggcccgttccccttacccgtacgtaaccctcgggttccccggaccggtctacccgtacggcggtaacggacggtaaccgnggttacttatttaactttagtacttagttactactaatacttaaccgagtcggtaactcggttcgggtttacggccggtaacgggacggtacgcgtacggtcgttaaccgtcccggtagtaccgccgtaacggcacggtccccgtccgtacccgngttaccctcccgttccgtccccncccgtcgtacccg

SEQ ID NO: 274499 - DNA, 751 bp, Homo sapiens
  misc_feature: GYAE6OF01ELE1J.27.23.C01.1.454.CMB.1.raw
  modified_base (245)..(245): a, c, t, g, unknown or other
  misc_feature (245)..(245): n is a, c, g, or t
  modified_base (283)..(283): a, c, t, g, unknown or other
  misc_feature (283)..(283): n is a, c, g, or t
  modified_base (602)..(602): a, c, t, g, unknown or other
  misc_feature (602)..(602): n is a, c, g, or t
  modified_base (663)..(663): a, c, t, g, unknown or other
  misc_feature (663)..(663): n is a, c, g, or t
  modified_base (725)..(725): a, c, t, g, unknown or other
  misc_feature (725)..(725): n is a, c, g, or t
tcagagcgtcgtctcacgaccggtgctcgatttagtacacgtgattagggattggggggggtctcaggaggcagcgctcgtcgggacgtctccaccatggcctggctctgctattcctcaccctcctcactcagggcacgaggtcctgggcccagtctcgccctgactcagcctgcctcgtgtctggtctccgtggactagtcgactccacctacttctccgtcgacaccggtacggaaccccgngtagtggtacgttggtacttactttaacttaacttttnttcgttggtttacggaaccgacgaccggaccgagcctacttaccgtaccctaaactcgttaactttctttatgtattcgtacgtaacgtaccgtccggttaccccggttaggtttctgtaccgttcttacgttacgttacgtcggtactaccgtaacgttcctaccgtaccctaaccggtccccggttcctacccgtacgtacccgtaccgtccggtacccgtccgacgtaccggtaccgtagggaacggtacggtagttcgtaacgttaagttttattacggtagtttaacgtactacttaaacgacgttaaacggtntaacgttacggttacgggtttacgggtcgggtacgggaccggtaccggtacgcgttaccgnggtaccccttagtaccgggacgtaccgtaccgacgttcccgtacccgtcccgtatacccgtnttccccgtcccggttccccggttacc

SEQ ID NO: 274500 - DNA, 911 bp, Homo sapiens
  misc_feature: GYAE6OF01AY52J.27.23.C01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacngtcgatcaccatcctcctgcacgtacgggaaccccgngagtggtacggttggtgtaccttaattaactttatcgttggttacggtaccgacgacggacccgaggacctaccgtaccgtacccccctaaaagttcctacttttactttagtagtacttacggtaccgtaacggttaacgtcccccggggtacccccgttagggggttttacctaggttaaccgttccggttacctttacgttacggtccggtacctaaccgtaaggtcctacggtacccctaaccggtccccgtccccttaccccgtacggaaccctcgttcccggtcccgggtccctacccgacggtcccgtacggggaacgggtaccggtacggtacgttacgttaagtttttaagttacgtttacgtttaacgttactaacgttaaaccgtaaacccgtaacggtaaccggttaacgtaacccggtttacgggggttttccggggttacgggttaccgggggtacggggtaacccggggtaccggtaacgggttcccgggtaacccggtaccccggtttacccggttaacgggtacccccggaacccgggtaaccccggaacccggggttccccgtaccccccgggtccccccggtttacggttaccccgttaacccgtttccccggtttcccccggttaccccccgttccccggttaacccccgg

SEQ ID NO: 274501 - DNA, 832 bp, Homo sapiens
  misc_feature: GYAE6OF01B7KX8.27.23.C01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagagcgtcgtctcacgaccggtgctcgatttagtacacgtgattagggagttggggggggtctcaggaggcagcgctcgtcgggacgtctccaccagtcggcctgggctctgctattcctcaccctcctcactcgagggcacgacgggtcctcgggccctagtctcgccctgacctcacgcctcgcctcgtgtcgtcgggtctcgtgacngtcactcacctactctctcgacctacgtacggaccncgagttggtacggttggtactacttaacttaactttgttcgttacggttacggtaccgaaccgtacggaacccgtacgacctaccgttacccgtaacccctaacttccttattttacgtttagtacgttacgttacgtaactaacggttaccggtacccgggtaccccgggtttagggtttacctacggttaccggtcctttacggttaccgtacggttcggtacctaaccgttacgttccgtaccgtacccgtaaccggtacccgtcccgtaccgtaccgtacctacccggtcccggtacccgtccgtaaccgtccggtacgtaacggggaccggtaacggtacggttacttacgttaacgtttagtttacgttaagttactactaaacgttaactaaccgtagtacgtacgtaccggtttagttacggggttcggtacggggaacgtcgggacttcgggtaccgaaccggtccgtacggtacggtaccgacccgtacggtaacccggtcccgtaccccggttacccggttacgttccccgttaacccgtttccccttaccccgtccccgtcgttaaaccccg

SEQ ID NO: 274502 - DNA, 711 bp, Homo sapiens
  misc_feature: GYAE6OF01CKS0N.27.23.C01.1.454.CMB.1.raw
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgngatgtacggttggtgctttataacttttntcttgttcggtaccgacgtacggacccaggccacgtcgtaaccccaagtcacgttttcctttaagtcgtatgttaccaaggttaaccgtcccgggtaccccgttagggggttttcctaggtacttccggtcttttctacgtcggtacctaccgtaagtcctcgtacccttaacgaccggtccctcccgtacgtacccgtacgttcccggtcccgggcctccgacggtccgtacgggaacggtacgggtacggtcgttagtaatttagtttagttacgttagttactattaacgtaacaacgtacgtacgtacgtacggtttgggtacggttccgggacgggacgggtaccgcggacgttccggaccgtacggtacgtacgaccggacccgaaggtcccgtcccgtccccgttacggtcccacgtttcctcccgttcccctcccgttccg

SEQ ID NO: 274503 - DNA, 739 bp, Homo sapiens
  misc_feature: GYAE6OF01ELBET.27.23.C01.1.454.CMB.1.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcatcaccatcctctgccactggaaccccgngatgacgttgngtcttaataactttatctgttcggtaccgacgacgaccaggcactcgtaccccaaactctacttctttatgtagtgtactaggtaacgtccgggtacccccgtaggggtttctgtacgccgttaccttactagtcggtacctccgtaacggttcctcgtacccgttaaccgacccggtccctacccctcgaccgtaccgtccgtcccgggcttcccgacgtccgtacggaacgggacgtaggtctagttatttaagtttagtttaggtacgttaactaagttaactaaccgtaaccgtaagtacggacgttaacgggtttggggttacgggtttccgggaacggggtacggtaacccgacgggtccgtacggtacccgttccggttaaacggtccgaacccggtacccgtaacgggtcccgttaccccggccccccggtttacggtacccgttaccccgttacccgtttcccccgttccccgtacccccgttacccgg

SEQ ID NO: 274504 - DNA, 744 bp, Homo sapiens
  misc_feature: GYAE6OF01C2BLQ.27.23.C01.1.454.CMB.1.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (536)..(536): a, c, t, g, unknown or other
  misc_feature (536)..(536): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcacccctcctcactcagggcacgacgggtcctgggcccagtctgccctgactcagcctgccctcgtgtcgtgggtcctcctggacagtcgatccacnttcctcctgcacgtcggaacccgngatgtacgttgtctacttattaactttgtctggtacgtaccgagacgaccgngctactaccgacccaatctatttcttagtntactgtacagttaccgcccggtacccgttagggtttcacgtctccggttcttagtactccggtactacccgttaagtcctacgtacctaccggcccgttacccctcccgtacgacccttacgtccccggtcccgggtactacccgtaccggtacccgacggacggtaccggagttcgttaaggttaatttacgttagtttacgtaacgttaanaactttaaaccgtaaccgaaccgttaacgttacgtaacccggtttagggtttacggggtccgggttaaccgggcggggtaacggacccgtaggtccgttaccgggtaacccgtcgggtaacgccggtccgaacccgggtcgtcccgttccccggtcccccgtagttcccgtaacttcccgttcccccggtccccgttccctaacccgg

SEQ ID NO: 274505 - DNA, 753 bp, Homo sapiens
  misc_feature: GYAE6OF01C9J37.27.23.C01.1.454.CMB.1.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggccacgagggtcctgggcccagtctgccctgactcagcctgcctccgtgtctgggtctccgtggacagtcgatcaccatcctcctgccacgtcggaacccgngatggacgttggtncttattactttntctgttgtaccganacggacccaggcactccgtaccccaaatctactttctttatgattgtcagtacgtccggccccgtagggtttcagtctcgtcttctacgtcggtcctaccgtaacgttccgtaccgtcctaccgtacccggtccctccccgttacgaaccctcgttcccggtaccggcctaccgacgtccgtaggacggagacggtctagtatttacgttagttgttacgttactaacttaactacgtaaccgtagtacgtaccgtacggtttacggggttcggttaccgggggaccgggtaacggggtaccctcggggtacccgttaccggttaaccccggttaccgggttacggtcccggtaaaacccgggtccccggtaaaccgggttccccgttacccccgggtaccccccgttaccgggtttccccttaacccggtttcccccggtttcccccggtttccccccgtccccggtttaccccg

SEQ ID NO: 274506 - DNA, 806 bp, Homo sapiens
  misc_feature: GYAE6OF01CCJ3W.27.23.C01.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaaccntctccngccactggaaccccgngatcggtacggttggtagtactttaattaaactttntcgttggttacggtaccgacgaacggacccaggcctacgtccgtaccccaaaactctaattttacctttaatgtaactcgtactaaggtaaccgttcccgggaccccggttaggggtttcctagtacgtacgtcttactaacgtcggtacctacccgtaagttccgtaccgtacccgtaacccgaccggtccccctaccgtacccgaaccgtaccgttcccggtcccgggtaccttacccgtacgtcccgtaacggggtaacgggaaccgggtacggtcttaaggttaaacttttaagtttaagtttacggttaacgtttactaaactttaacctaaaccgtaaaccgttaacggtacggttaaccgtaacgggtttttcggggtaccgggttacggggaccggggtaacgggaacccgtacgggccgtaccggttacccgtaccgggtagtacccgtaccgacccggtacggccttcccccgggtaccccttccgggttaccaccttaccgttcccgtacccctaccccgtaccg

SEQ ID NO: 274507 - DNA, 812 bp, Homo sapiens
  misc_feature: GYAE6OF01CDLX1.27.23.C01.1.454.CMB.1.raw
  modified_base (140)..(140): a, c, t, g, unknown or other
  misc_feature (140)..(140): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (376)..(376): a, c, t, g, unknown or other
  misc_feature (376)..(376): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacgnggtcctgggcccagtctgccctgactcagcctgcctcgtgtcgtgggtctccgtggacagtcgatccaccntctcctgctacgtacggacccngattagacggtttggtacttactttataaccttttntcgttggttacgtaccgacgacggacccgaggacacgtcgtacccaaactctatttccttatgtattgtacgtagttaaccgtcccggtaccccggttagggtttcnggttactcgttcttctacgtcgtcctacgaacgttcgtccgtacctccggacccggtccctaccgtacgtaccgtaccttcccggtcccgggtacctccgacgtccggtacgggaacgggtaccggtacggttaccgttagttaagtttaacgtttactttaacgggtttacgtttacgtaaacttaaccgttaaaccgacgttaaccggtacgtaaccggtttacgggtttacgggtttccggggtaccgggtacgggggtaacccgggtaaccgggtccggttaccgggtccgtacccgggttaaccgtcccggggtaaccgtacccggtaaccccggaccgggtttcccggttacccccgggtccccccgttacgggttaccccttacccggttacccgtttcccccggttcccccgttacccttacccccgg

SEQ ID NO: 274508 - DNA, 815 bp, Homo sapiens
  misc_feature: GYAE6OF01CVJ3S.27.23.C01.1.454.CMB.1.raw
tcagagcgtcgtctcacgaccggtgctcgatttagtacacgtgattagggagttgggggggggtctcaggaggcagcgctctcgggacgtctccaccatggcctggctctgctattcctcaccctcctcactcagggcacgagggtcctgggcccagtctcgccctgactcagcctgcctccgtgtcgtgggtctccgtggacagtcgataccacctatcctcctggacctacgtccggaaccccgcgtagtcggtacggtttggtcgtactttaattaactttagtcgttggttacggtacccgaacgaccggacccgaggacctaccgtaccgtaacccctaaacttcttaacttttacgtttagtgtaacgtttcggtacgtaaacggttaacccggttccccgggtaccccggtttaggggttttacacgttacgttccggttactttacggtaacgttccggtaccttacgtacgttccgtacgtacccgtaccgacccgttccctaccctacgaccctacggtcccgtccgggtcctaccgcgtccgtaggaccggagtacgtcgttagttaaactttgtttagttacgttacgttactaacttaacgtaacccgtaagtacgtactaacgttacggttaggttaccgttcggggtacggacgggacgggacgtacggttacccgtaccggtacccggttacgaccggtaccgacccggtaaccggtaccggcccccgttaccccggtacccccggtttacggtaacccctttcccttacccgtttccccgtaaccccccgttaccccg

SEQ ID NO: 274509 - DNA, 813 bp, Homo sapiens
  misc_feature: GYAE6OF01AZWEA.27.23.C01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatccaccatcctcctgacactgggaaccccgngatcggacgttggtcgtactttaataactttatcttgttcggtaccgacacggacccaggccactcgtaccccaaactctactttactttatagtattgtactaaggtaacgtcccgggtaccccccgttaggggtttcctaggtacgtaccgtccgtttaccgttagttaccggtacctaccgtaaacggttccgtaccggtacccgttaacccgacccgggtccccttaccccgttaccggtaaccccgtaacccgttcccggttaccccgggtacccttaccccggaccggtcccgttaacgggaccgggaaccgggtacggtacggttaagttacgttttaactttacgttttacggttacgtttacctaagttaacttaaccgtaaaccgtagttaccggtaacggttacggtttacggggttcggttacggggacggtaaccggggtaccgacggtcggtaccgtaccggtaccgtacggtacgacccgggtaccgacggtcccgtccccggtaccccgtccgggttaccctaccgttacccgtcccggtttccccgtccccgttacccg

SEQ ID NO: 274510 - DNA, 714 bp, Homo sapiens
  misc_feature: GYAE6OF01C2Q4K.27.23.C01.1.454.CMB.1.raw
  modified_base (176)..(176): a, c, t, g, unknown or other
  misc_feature (176)..(176): n is a, c, g, or t
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (574)..(574): a, c, t, g, unknown or other
  misc_feature (574)..(574): n is a, c, g, or t
  modified_base (695)..(695): a, c, t, g, unknown or other
  misc_feature (695)..(695): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctctcactcgaggcacgacgggtctcggcccagtctcgccctgactcagccngtcctccgtgtcgtggtcctcgtggacngtcactcaccntcctcacncacgtcgaaccgngtacgtgtacgttggtactcttaattacttatcgttgtacggtaccgacgtaccgaccgaggcctctccgaccctaatctactttntntagtntgtacgtaacgtaccggtcccggcccggttaggtttcacgtctccgttctacgtcgtcgtacctacgtacgtccgtactcctaccggccgtccttccgcaaccgtctcccggtcggcctaccggcgtcgtaggacggacgtgtactagttactttatacttggttaactacattaacccgtacagtagttaccgtacggttcgggtttacgggccgggttaaccgggacgggacgggttaaccgnggttaccccgaacggtttacccctcgggtaaaccgccccggtaacggggtacccctaccggggtccccttccccgggttccccgacgttaccccgtccctttacccgggttaacccccccncccgtaacccgttacccgg

SEQ ID NO: 274511 - DNA, 677 bp, Homo sapiens
  misc_feature: GYAE6OF01CIUN9.27.23.C01.1.454.CMB.1.raw
  modified_base (274)..(274): a, c, t, g, unknown or other
  misc_feature (274)..(274): n is a, c, g, or t
  modified_base (481)..(481): a, c, t, g, unknown or other
  misc_feature (481)..(481): n is a, c, g, or t
tcagagcgtcgtctcacgaccggtgctcgatttagtacacgtgattagggagttgggggggggtctcaggaggcagcgctctcgggacgtctccacatggcctggctctgctattcctcaccctcctcactcagggcacgagggtcctgggcccagtctcgccctgactcagcctgcctcgtgtctgggtctcgtggacagtcgatccaccatcctcctgccacgtcgggaaccccgtgaatcggtacggttgggtctactttaattaactttntcttggttcggtaaccgacgacggtacccaggtccacctccgtaccccaaactctattttactttaagtgtatgtacagttaacgtccggccccgttagggtttctgactcgtcttctacgtcgcctcaacgtctcgacctacgaccgtcctcccgacgacctacgttccggtccggacctccgtaggtccgtagggacggtacggngtacgtagtaatttacgttagttaggttacgttacaacttaactaacccgagtaacgtacgtacgttacggtttggggtacggttccggggacgggaccggacgtacggtccgtacgacccgtcgtacggtccgaacgtccggaacgccgttcccgcccgttcggtacctacgtccttccgtccccgtccctaccg

SEQ ID NO: 274512 - DNA, 791 bp, Homo sapiens
  misc_feature: GYAE6OF01EM69K.27.23.C01.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
  modified_base (781)..(781): a, c, t, g, unknown or other
  misc_feature (781)..(781): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtctctggacngtcgatcacctatcctcctgcacgtcggaccgcgtagtcgtacggttggngtactttaacttaacttttactcgttggtttaccggtaaccgtaacgaacccggtacccgaggtcctaaccgttaccggtaacccccctaaaacgtccttaacttttcctttttaacgtacggttacgttcggttaccgtaaacggtttaaccggtcccccggggtacccccggtttaggggtttccttaggtaccgttccgtttcgttacttacgtcggtaccttaccgtaacgttcctgtaccccgtacctcccggtacccttccgtacgtaccctacgtcccggtccggtcctccgaccggtcgtacgggaacggtacgggactacgttagttaacttgtttaacgttgttactaccgttaataactaaccgtaacgtgtaaggtaccttgggttacgggtcggttacggggacggttagggtccgtacggtcccgtcggtacccgttcggtaccggtcgaccggaccggtacgtcccgggtaccccgtcccttaccggtcgttaccctaccggttcccggttaccccnccgttacccg

SEQ ID NO: 274513 - DNA, 647 bp, Homo sapiens
  misc_feature: GYAE6OF01CM8GQ.27.23.C01.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (446)..(446): a, c, t, g, unknown or other
  misc_feature (446)..(446): n is a, c, g, or t
  modified_base (555)..(555): a, c, t, g, unknown or other
  misc_feature (555)..(555): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggccccagtctgccctgactcagcctgcctccgtgtctgggtctccgtggacagtcgatccacatcctctgccacgtcggaacccgngatgacgttgngtcttattaacttntcgttggttacgtaccgtacacggacccaggccactacgtaccccaatcatttcttaatgatgtactagtacgtccggccccgttagggtttctgtactcgtcttcgtagtcgtacttccgtaacgtcctacgtaccctaaccgtacccggccccttacccgtacgaccctactccggtcccggtcnccgtacgtccgaggacggacgagtctagtaacttatttagttagttacgttacaatttaacaaccaacgtacgtacacgtacggttgggtacgtcggacgggacgtcgngtccgtcgtaccgtcgtacgtcgaccgaccgaacggtccgtcccgtccccgttggtacccacgttaccgtcccgttccccgtcccgtacccg

SEQ ID NO: 274514 - DNA, 981 bp, Homo sapiens
  misc_feature: GYAE6OF01C01WH.27.23.C01.1.454.CMB.1.raw
  modified_base (244)..(244): a, c, t, g, unknown or other
  misc_feature (244)..(244): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgactcagcctcgcctccgtgtcgtcgggtcctccgtggacagtcgatccaccatctcctgccacgtacgggaacccgngtagtcggtacggttggtcgtactttaattaaccttttagtcgttaggtttacggtaaccggaacgaaccgggaacccgtacgggacctaaccggttaccgtaacccccctaaaacttacctttaacgtttttacctttaagttacggtattacgttaacgtaacggtttaaaccggtccccgggtaccccccggtttaagggggttttcctaggttaaccgttccggttactttacgttaacgtcgggtacccttaaccggtaaacggttccgttacgtaccccgtaaccggacccggttacccccttacccgttaccggaaacccgttccggttacccggacccggggtacccttaccccggaacggtcccgtaacggggaacgggttaaccggacggtacttaagggtttaacttttaagttttaacggttacgggtttaaacttccgtttaaaacttaaccctaaacgtaacccggttaaggtacggttaaacccggttaacggggttttcggggttaccggggttaccgggaacccggggggtaagggaccccggtaaggcccggtttaccgggtaccccgggtttaacggtaaccgggtacccgggtaacccggtaacccgggttaccgggccccggtttacccccggtacccccccggtttgggtaaaccccccgttcccgttaaccccgtttccccccgggttacccccgtaaccccccgttaccccgg

SEQ ID NO: 274515 - DNA, 704 bp, Homo sapiens
  misc_feature: GYAE6OF01E0HAT.27.23.C01.1.454.CMB.1.raw
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcagggcacagggtcctgggccctagtctgccctgacctcacgctatcgccctcgtgtcgtgggtctccgtgacagtcatcacntctcngcncgtgaacccnagtgacgttgtctacttaattacgttatcgtgtcggtacacgacgaccgtcgcactcgaccccaatctagtttcttagtctacttgtacagtaaccgtcccggtacccgttagggttctgtacgttcgtacgttacctaggtcggtacctacgttaacgtctacggtaccctaccgtaccgtccccttaccgactacccgtacgttcccggtacccggtcctacccggtaacgtccgtacgggtaaccgggaggtacgtacgttaagttactttagttttagttacggttaatttacaaacgttacaaccggttacgtagttaaccggttcgtacgggttcgggttaacggtcgggtaacggtaacggacccgtagtacccgggacgttacccgtacggacgtcccgaaaccggtccgtacgtcccggtccccgtccgtacttcccgtaccttccggtcccctccctaaccg

SEQ ID NO: 274516 - DNA, 833 bp, Homo sapiens
  misc_feature: GYAE6OF01D5BWE.27.23.C01.1.454.CMB.1.raw
  modified_base (262)..(262): a, c, t, g, unknown or other
  misc_feature (262)..(262): n is a, c, g, or t
tcagagcgtcgtctcacgaccggtgctcgatttagtacacgtgattagggagttgggggggggtctcaggaggcagcgctcgtcgggacgtctccaccatggcctgggctctgctattcctccaccctcctcactcgagggcacgagggtccgtcgggcccagtctcgccctgactcacgcctcgcctccgtgtcgtcgggtctccgtaggacgtaggtcgactccaacctctcctcctcgacctaccgtacgggaacccgngtacgtcggtacggttggtcgttactttaatttaactttattcgttggttaccggtaaccgacgacggacccgaggacctacctaccgtaacccaacttcttatttactttagtcgtatacgtacgtagtaccgtcccggtacccggttagggttctagtcgtccgtacttctacgtcgtaccctacgtacgtcctaccgtaccgtaccgacccgtccctaccgtcgtacccgtccgttcccggtcccgggactaccgacggtccggtaagggacggtaacggtcgttattaacgttaatttactttcggtttaacgttacgttaagttaaccctaacgttaaaccgtaacgtaacgggtcgtttaaaccggtttcggggtttacggggttaccggggtaccggggtaacggggaaccgggtaacccggtccgggtaacggtcccccggttaacgtaaccggttcccgggtaacgacccggcccggtaacccggtcccttcccccgggttaaccccgtccggtaacccgttcccgttaacccgtccccggttcccccgcccgttaacccgg

SEQ ID NO: 274517 - DNA, 760 bp, Homo sapiens
  misc_feature: GYAE6OF01ANFTS.27.23.C01.1.454.CMB.1.raw
  modified_base (330)..(330): a, c, t, g, unknown or other
  misc_feature (330)..(330): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgcgatgacgtttggtgtctttaattaacttttagtcttggttcggttaaccgacgacggacccaggccactcgtacccccaaactctactttctttagngtatgtactaggtaactcccgggaccccgtaggggtttctgtactcgtcttcgtagtcggctaccgtaagttcctacggtcctaaccgaccggtcccctccctacggtaccctacgtccccgtcccgggccttacccgacggtacccgtacgggaacggtaccggtacgggtaccttaggtaacttttagtttaacgtttacgttaagtttacctaattaaccgtaacccaacgtacgtagtaaccgttaacggttcggggtacggtttcgggaccgggtaacgggacccgtagggtacccgtacggtaccccgggttacgtacgggttcccgaaccgggacccgtaacggggtcccttaccccggaccccccggttcggtacccgttacccgttcccgtttccccggttcccccgtcccgttaaccccg

SEQ ID NO: 274518 - DNA, 652 bp, Homo sapiens
  misc_feature: GYAE6OF01E3APV.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (644)..(644): a, c, t, g, unknown or other
  misc_feature (644)..(644): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggncttataactttntctgttggtaccgacaggacccaggcactcgtaccccaactctatttctttatgattcgtactagtaacgtcccgggacccccgttaggggttttcctgtattcgtcttctagtcggtcctaccaaagttctacgtcccgttaccgacccggtcccctcccgtacgaccccgtacgtcccggtcccgggtcctaccgaccgtaccgtaggaacggaccggtaggtcttagttatttattattagtacgtttacattaactaacaacctagtacacgttacgtgggttcgtccgggaggtaacgggaccgtacggctcgtaccgtccgtaggtccacggtaccgacggtccgtacccgcccccgttgtccctacgttcccgtcccttccccncccgttcc

SEQ ID NO: 274519 - DNA, 780 bp, Homo sapiens
  misc_feature: GYAE6OF01C54EX.27.23.C01.1.454.CMB.1.raw
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (337)..(337): a, c, t, g, unknown or other
  misc_feature (337)..(337): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcgagggcacgagggtcctgggcccagtctcgccctgactcacgcctgcctccgtgtctgggtctcctggacagtcgatccaccatcctcctgaccacgtcggaaccccgngtatcggtacgttgggtntactttattaacttntcgttggttacgtaccganacggacccgagctacctccgtaaccccaactctatttctttacngattgtcaacgtaacgtccggtaccccgtagggtttctagtactcggtacttctacgtcggtacctcgaaagtctcggtaccttaccgaccggttccctacccgtacgaccctacgttcccgtccgggtcctacccgtacgcccgtacgggaacgggacgtacggtcgttaagttaagtttagttttacgttagttaacgttaacgtaattaaccttaaacccgaacccgtaagggttacgtaaccgttacggggttttaccgggttcggggtttacgggaaccggggtacggtaacccgtaccggggtacctttacgggaaccccggtttacggtaccgggtaccgtaccggaacccggttacgggtcccctaccccgggttcccccgtcgggttaccctacccgggtttccttccccggtcccccggttccccttaaccgg

SEQ ID NO: 274520 - DNA, 702 bp, Homo sapiens
  misc_feature: GYAE6OF01C631I.27.23.C01.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (356)..(356): a, c, t, g, unknown or other
  misc_feature (356)..(356): n is a, c, g, or t
  modified_base (557)..(557): a, c, t, g, unknown or other
  misc_feature (557)..(557): n is a, c, g, or t
tcagagcgtcgtctcacgaccggtgctcgatttagtacacgtgattagggagttggggggggtctcaggaggcagcgctcgtcgggacgtctccaccatggcctgggctctgctattcctcaccctctcactcgagggcacgaggtcctgggcccagtctgccctgactcagcctgcctcgtgtcgtggtctaccgnggacngtcgactcaccatcctccgtgacacgtcggaacccgngaagtcgtacgttggtactactttaattaacctttgtccgttggtttaccggaccgaacgacggacccgaggtcctaccggttacctaacccctaaattcttaacttttacttaagnggttatacgtaccgttagtaaccgtcccggtaccccgttagggtttcagttaacgtcgtctacgttcgcggtacctaccctagtcctcggtaccctaccggtaccggtccctacgtaccgaactcgtccgtcccggtaccacggaccgttccgagggactaccgggtagtaccttagtactttaaagctttaggacttaanaacgttacaaccgaatgtactcgttacggttcgggtacgtacggacgggaacggttcaggtcctacggtacttccggataccgacggtaccgagtcccgtacccctcggttacgacctaccgttccgtacccgtcccgcgtaccg

SEQ ID NO: 274521 - DNA, 694 bp, Homo sapiens
  misc_feature: GYAE6OF01CXAC5.27.23.C01.1.454.CMB.1.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (350)..(350): a, c, t, g, unknown or other
  misc_feature (350)..(350): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcacctatcctcctgccactcggaacccngatggacgttggtncttaatactttntctgttcgtaccgacgacggaccaggcactcgtacccctaatctatttctttatgtatgtacgagtaacgtccggtacccgtagggtttcngtactcgtcttacgtacgtcggtcctaccgtaacgtccgtacgtaccgtaccgtaccggtcccttacccgtacgaccctaccgtccggtcccgggtacctccgacggtccgtacgggacggtacggtacggtccgttaggtaactttaacgttagtttacggttaacgtttactaagtttaaccgtaaacctaaccgtagttaacgtaccgttaacggttgggttaccggttcgggacgggtacggacgacggtccgtacggtacccgtgtacggtacgaccggtaccgacggtccgtccgccccgttacggtcctacggtcctcccgttcccctccgtacccg

SEQ ID NO: 274522 - DNA, 808 bp, Homo sapiens
  misc_feature: GYAE6OF01EJFI6.27.23.C01.1.454.CMB.1.raw
  modified_base (797)..(797): a, c, t, g, unknown or other
  misc_feature (797)..(797): n is a, c, g, or t
tcagagcgtcgtctcacgaccggtgctcgatttagtacacgtgattagggagttggggggggtctcaggaggcagcgctctcgggacgtctccaccagtggcctgggctctgctattcctcaccctctcactcagggcacagggtcctgggcccagtctcgccctgactcacgcctcgcctccgtgtcgtcgggtcctccgtggactcgtcgatccacctacttcctccgtagacctacgtacgggacccgacgtacgtacggtacggttgggtattactttaaacttaactttacttcgttggttacggtacccgaacgaccggaacccgagacctacttaccgtaacccctaaatcttacttttctttactgtactcgtactaaggtaccgtcccgggtacccggttagggtttctgtacgtcgttacttcgtagtccggtacctaactacggtcctacgtacccaccggtacccgtccctcccgtacaacctcgtcccggaccggtccacgtacgtccgtagggaaccggacggtacgtagttacgtttaactttagtttacgtttacgtttaactacttaaataaaccgtaacctaacggtacgtacggttaacgttacgggtttcgggggttacggtaccggggaaccggggtacgtaacccggtagggttccgtaacccggtaccgttaccggtaacggtaccccgtaccggaacccgtaaccggtccccgttacccccggccccgtttacccggttacttaccccggttccggttcccccggtttccccncccggttaccc

SEQ ID NO: 274523 - DNA, 696 bp, Homo sapiens
  misc_feature: GYAE6OF01CTH2N.27.23.C01.1.454.CMB.1.raw
  modified_base (223)..(223): a, c, t, g, unknown or other
  misc_feature (223)..(223): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgacgggtcctgggcccagtctcgccctgactcagcctcgcctccgtgtcgtggtcctccgtggacagtcatcacctatcctcngctacgtacggaacccgtgatacggtacgttggtctactttaacttaacttttctcgttaggtacggtaaccgacgacggaccctaggcctacgtaccacccctaattctatttcttatgactgtacaggtactcccggtcccgttagggttcagtctacgtcttacgagtcgacctacacgtcgtaccgcctacggcccgccttccacgaacccgtctcccgggccgtacctaccgcggtcgtaggcggtacggacgttcgtagtaactttagttatacggttattaccgtataacgtacctaagacgtacgtagttacggttgggaccggttcgggaacggtacgaccggacggtcgtaccgtacccggtacgtaacgtaccgaccgtacccggtaaggtcccctacccgggtaccccccttcggtacccttacccttcccgttaccccgttacccccctccggttacccg

SEQ ID NO: 274524 - DNA, 820 bp, Homo sapiens
  misc_feature: GYAE6OF01BGGLH.27.23.C01.1.454.CMB.1.raw
  modified_base (248)..(248): a, c, t, g, unknown or other
  misc_feature (248)..(248): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcgagggcacgagggtcctcgggcccagtctcgccctgactcacgcctgcctcgtgtcgtgggtctcgtggactagtcgactccaccatcctccgtcgcacctacgggaaccccgngtaagtcggtacggttggtctactttaaacttaagttttctcgtttgggttacggtaccgtacggaaccggaccgaggtcctacgtacctaacccctaaacttctaattttccgttaagtgtacttacgacgttaacgtaaccggtcccggacccgtttggggtttactacggttactccgttatttaccttaggtacggtaccttaaccgtaacggtcttacccgacccgtacgtacccgtcccgttacccgttaagaacccttcgtcccggtccgggtactaccgacgtccgtagggacgacggttacgtcttagttaactttagtttactacggtttactcgtaaactacgaacgttaacgagtttaacgttacgttaacgggttcggggtttacgggaccgggaacgggttacgaccggttacggtcccggtaaccggttacccggtaggttaaaaccgggccccgtacggaacccgggttacgggccccctttaccccgggaccccggtttaaccggtccttaacccggttccccgttccgggtttaccccccgtccccgtaaccgg

SEQ ID NO: 274525 - DNA, 589 bp, Homo sapiens
  misc_feature: GYAE6OF01ERCEA.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (444)..(444): a, c, t, g, unknown or other
  misc_feature (444)..(444): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttgngcttataactttatctgttggtaccgacaggacccaggcactgtaccccaaactctattctttatgactgtcagtaacttcggcccctagggtttctggatcgcttctatcggctacaagtctgtcctacgtacggcctccctagacctatccgtccgggctccgacgcctgacggacgaggctgtattattactgttattnactatacaacatcgactattgggtgttacgggcggacgggcaggtctacggaccgttaccgtagggttaccacggtacccgaacggtctaccggtccccccgttcggtacctacccgtaccttccggttcccccgcccttacccg

SEQ ID NO: 274526 - DNA, 684 bp, Homo sapiens
  misc_feature: GYAE6OF01B3SCH.27.23.C01.1.454.CMB.1.raw
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (337)..(337): a, c, t, g, unknown or other
  misc_feature (337)..(337): n is a, c, g, or t
  modified_base (527)..(527): a, c, t, g, unknown or other
  misc_feature (527)..(527): n is a, c, g, or t
tcagagcgtcgtctcacgaccggtgctcgatttagtacacgtgattagggagttggggggggtctcaggaggcagcgctctcgggacgtctccaccatggcctgggctctgcttattcctcaccctcctcactcagggcacgagggtcctgggcccagtctgccctgactcagcctgcctccgtgtcgtgggtcctccgtggacagtcgatcaccntctcctgcacgcggaacccgcgtatggtacgttggtntacttaattaactttntcgttggtcggtaccgacgacggaccgaggactaccgtacgtacccctaaatctactttacgtttaancgttatacgtactaacggttaacgtcccggtaccccggttaggggttttccacggttactccgttacctttgtaacgtcgtaccgtaccgaaggttccctcgacccgtcgtaccggtccctaccgtacgactccgttccgtacccggctccgagtccgagtacggtagacggtctagtatttattacgtntagtactataccaacgactagtagaacgttcgggttaggtcgggtacggcgggaacgtaccgaggtcccgtagtaccgtcgtacggcgtaaccgcccgacgtcggtccccgtaaccccgttgacccttaccttaccgtccccgtaccctcccgtccg

SEQ ID NO: 274527 - DNA, 749 bp, Homo sapiens
  misc_feature: GYAE6OF01EECVE.27.23.C01.1.454.CMB.1.raw
  modified_base (325)..(325): a, c, t, g, unknown or other
  misc_feature (325)..(325): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcacgcctgcctccgtgtctgggtcctcgtggacagtcgatcaccatcctcctgcacgtcggaacccgcgagtgtacggttggtgtcttaataactttatcgtggttcggtaccgactaggacccaggcacctcgtaccccaaactctatttcctttangtacttgtacgtaaggtaacgtcccgggtacccccgttaggggtttcctagtacttccggtctttacctagtccggtaccttaccgtaacgtccgtaccgtacccgtaaccgacccggtccccttacccgtacggtaacccctacgttcccggtacccgggtcctcccgaacggtcccgtacgggacgggaccggtaggtcgtacggttaatttatttacgtttaggttaacgtttactaattaaccttaaccgtaacccgttgtaacgttacgtacgggtttcggggtacggtttcgggacgggtacggaccggacggtcgtaccggtaccgttaccggtacggtccgaccgtacccggaaggtcccgtacccgccccggttacggtcctaccgttcccttccggtccccccgtcgtaccccg

SEQ ID NO: 274528 - DNA, 789 bp, Homo sapiens
  misc_feature: GYAE6OF01CMCFN.27.23.C01.1.454.CMB.1.raw
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatctcctgacacgtacggaacccgtcggatggaacgttggtcgtactttattaactttatcgttggttacgtaccgacaacggaccaggactacgtcgtaccccaaacttctaatttctttaacgtgaatgtacaaaggttaacgtccgggaccccgttaaggggttttctagacgttaccgctttacgtatacggccttaacgaagttccgtacgaccgtaaccgaccggttccctccgtaacgacctaaccgtcgttacccgggactccgaacggtcctaggacggtaacggacggtcgttagtaatttacgttagtttagttaaccgttactaacttaactaaacgtaactaacggtacggtaaacttacgggtttacgggttacggggtttccgggaacgggtaacggggtaccgtaacgggttccggtaaccggtaacccggttacccgtttaagggaccgtaaaccccgggtaacccgtaacgggccccgttaccgtcccccccgggttaggtcccctaaacggttttccccggttaccccggttccccccgttacccggttaacccccg

SEQ ID NO: 274529 - DNA, 846 bp, Homo sapiens
  misc_feature: GYAE6OF01ETLMA.27.23.C01.1.454.CMB.1.raw
  modified_base (252)..(252): a, c, t, g, unknown or other
  misc_feature (252)..(252): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctcgggcccagtctcgccctgactcagcctgcctcgtgtcgtgggtctccgtaggactagtcgataccacctattccgtcctgactaccgtacgggaaccccgngtaagtcggtaacgtttgggtacgttacttttaaacgttaaaactttttacgttcgttacggtttacgggtaacccgaacggtaaccgggaacccaacgggtacctaaccgttaccgtaaccccctaaaacttaccgttacttttacctttagtagtagttacgtacgtaaggtaaccgtcccgggtaccccggttagggtttcctggtaactcgtacgttcgtacgtcgtaccgtacgtaacgtctacgtacctaccgaccggtccctaccgtacaccgtacttacccggtccgtacccgtaccgaccggttaccggaacggacggtaacgggtacggtccttaaggtttaactttaaacgtttacggtttaacgttacgttaccttaaacgtaacgtaaacccgtaaacgtagttaccgtaaccggttttaacggttcggggtttacgggtaccgggttacgggaaccgggtacggacggttaccgtaccggtacccgttacgaacgggtaccgaaccggtaccggaccggtcctccccggtaccccgttcggtaccttaccgtcctttacccccgtaccctacccgtaccg

SEQ ID NO: 274530 - DNA, 703 bp, Homo sapiens
  misc_feature: GYAE6OF01AVAA4.27.23.C01.1.454.CMB.1.raw
  modified_base (237)..(237): a, c, t, g, unknown or other
  misc_feature (237)..(237): n is a, c, g, or t
  modified_base (273)..(273): a, c, t, g, unknown or other
  misc_feature (273)..(273): n is a, c, g, or t
  modified_base (404)..(404): a, c, t, g, unknown or other
  misc_feature (404)..(404): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctcgtgtctggtctccgtggacagtcatcaccatccttcctgcctactacggggaaccccngattcggacggtttggctacttaattaaaccttttntctagttacggaaccgacgacggacccgaggacctactcgtaccccaaactctactttctttatagtatgtacagtaccgtcccggaccccgtagggttctggtactcgtcttactgtcgtctacacgtcncgaccctacgacgtcccgtacctcgacctacgtcccgtccgggtcctccgacgtccgtagaacgggacgtaggcttaacggttaattacgtttagttagtacgttactaacgttaacgtaaacctaaccgacgtttaaggacgttacgggtttacggtcgggttacgggacgggaccggtaacgtaccggtagtcggtaaccgtccggtaacggtaccgaccggcccgtaaacggtccgttcccggtaccccctaggtaccccgttaccgtaccctccgttaaccccgtccctacccgg

SEQ ID NO: 274531 - DNA, 831 bp, Homo sapiens
  misc_feature: GYAE6OF01BOR1Y.27.23.C01.1.454.CMB.1.raw
  modified_base (236)..(236): a, c, t, g, unknown or other
  misc_feature (236)..(236): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcatcaccatctcctgcacgtcggaacccgngtatggtacggttggtcgtactttaataactttatcgttggttacggtaccgacgacggaccaggtaccactaccgtaaccccaaactctatttactttatgtactcgtactaaggttaaccgtcccgggtaccccggttaggggtttcacgtacttcggtctttacgtagtcggtaccttacgaagttcctcgtacccgtaaccgtcccggtccccttaccggtacaccgtacggttcccggtacccgggtaccctaccggaccggtaccggtagggaaccggtacggtacggtaccttaggttaactttagtttacgtttaggtactttaactaacgttaacctaaccgtaacgtagggttaaccgtaacgttacggggtttacggggttaccggggtaccggggtaccggggtaacgggtacccgtacggggtaccgttaccgggtaaccccggtttcggtaaaccggggtcccgaaacccgggtacccgggtaacccggtcccgttccccccggtacccccgggttaccggtttacccgttaccccgtttacccggttcccccggttccccccggttacccgttaaccccg

SEQ ID NO: 274532 - DNA, 646 bp, Homo sapiens
  misc_feature: GYAE6OF01DIK84.27.23.C01.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
  modified_base (527)..(527): a, c, t, g, unknown or other
  misc_feature (527)..(527): n is a, c, g, or t
  modified_base (606)..(606): a, c, t, g, unknown or other
  misc_feature (606)..(606): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctcgccctgactcacgcctgcctcgtgtctgggtctcgtggacngtcgatcaccncttcctactgcctacgtacggaacccgngatcggtacgttggtntacttattaacttancgttgttacggtaccgacacggaccgagcactccgtaaccctaactctattctttanactntagacgtaagtaccgtccggtacccgttagggtttcacgtacgttccgttactttcgtacgtcgtactaccgtaattccgtcgaccctaccgccgtcccctcgtacctctaccttccggacccgtcacctacggtctaaggcgggaacgngtccgtaattacttagtttatgtacttnaagttaccaactacngggttactcggtcgtttagggtcggtacggcggacggtaacgcggtcaccggtcgtagaccggcgaccgagtacgtccncccgtaccctgtcctacgttcccgtccctccgtccctacg

SEQ ID NO: 274533 - DNA, 725 bp, Homo sapiens
  misc_feature: GYAE6OF01B1ZM9.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactcggaacccgcgatggtacgttgtgtctttaataactttatcgttgttcggtaccgacacggacccaggctactcgtaccccaaactctatttctttatgtactgtacagtaacgtcccggtaccccgtagggtttcctgtacgtccgtctttcgtacgtcggtacctaccgtaacggttccttacgtacccctaaccgtacccggtccccttccccgtagaccccgtacgtcccgtcccgggtccctacccggacggtcccgtagggacgggtaccgtaggtccgttaggtatttagtttagtttacgtagttactaataactaacctacgtagtacgtacgttacggttcgggttaggttaccgggacgggaacggtaccgtacgggtccgtaccgtaccggtcgtaccgggtacgaccggtacccggtaacggtcccgtcccggttaccccctcgggttccctaccgttacccgttccccgttcccccgtcccttacccg

SEQ ID NO: 274534 - DNA, 730 bp, Homo sapiens
  misc_feature: GYAE6OF01DSBIL.27.23.C01.1.454.CMB.1.raw
  modified_base (201)..(201): a, c, t, g, unknown or other
  misc_feature (201)..(201): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacaggggtcctgggcccagtctgccctgactcagcctgcctccgtgtcgtggtctcgtgacngtcgatccactctcctctgcctacgtacggaaccgtgagtacggtacggttggtctactttaacttaactttagtcgttggttacggtaccgaacgaccggaccgagacctacgtacccgtaaaccctaaactcttaatttcgtttagtgtagtcgtacgtaacggttaccgtccccgggtacccggtttagggtttctagtacgtcgttcttacgtagtcgtacctaccgtaacgtcctacgtaacctaccgacccgttcctacccgtacaaccgtacgttcccgggccggtacctaccgacgtccgtaagggacggacgtagtctaattaatttacttaggttacgtttaactactaaacttaccaacgtaacgtacgtacgtaacgtttcggggtttcgggtaacgggtccgggagggaaccgtcggtacggccgttacccggacgttcggtacgaccgaccggaacgtcggtcccgtccccgaccgttacgccttacccttccgttccccgtcccctcccgtacg

SEQ ID NO: 274535 - DNA, 812 bp, Homo sapiens
  misc_feature: GYAE6OF01CUZ2Y.27.23.C01.1.454.CMB.1.raw
  modified_base (786)..(786): a, c, t, g, unknown or other
  misc_feature (786)..(786): n is a, c, g, or t
tcagagcgtcgtctcacgaccggtgctcgatttagtacacgtgattagggagttggggggggtctcaggaggcagcgctcgtcgggacgtctccaccatggccgtgggctctgctattcctccaccctcctcactcgagggccacggtcgggtcctcgggcccagtctgccctgactcgacgtcctgccgtcgtgtcgtggtcctcgtggacagtcgactcacctattcctcgtgcgtaaccgtcggaacccgcgtaagtcggtaacggttggtacgtacttttaagtttaaacgtttgtacgttaggttaccggtaaaccggacgaaccggaacccgtacggtaccctaccgttaccgtaacccccttaaactcgtttaacttttaccggttatacggtacgttacgtacgtaaacggtaacccggtcccggtaaccccgggtttagggtttccacggttacttccggttacctacggttaccggtcggtaacctacggtaacggtccttccgtaacccgtaccgacccgttcccgtaaccgtggtaaacccttccgtaccggtccggacctaccgggacgtacgacgggtaacgacggtgtacgtacgttagtttacgtaggttacttaacgtataacgtaaccaacgtacgtacgtacggtacgtacgggtttcggaccgggtagggaccggtacggacgtacgtaccggtaccggtacgtaccggtacgtaacccggcggtcccgacgttcccggaccccgccccgttacgaccgttccccnccggttaccctcccgaccgttcccgg

SEQ ID NO: 274536 - DNA, 843 bp, Homo sapiens
  misc_feature: GYAE6OF01B15T3.27.23.C01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgactcgaccatcctcctgccactacggaacccgngatggacgttggtgtcttaatactttatcgttgttcggtaccgacacggacccgaggcctacgtccgtaccccaaacgttctaacgtttctttagtcgtatcgtacgtaacggttaaccgtcccggtacccccggttaggggtttcctaggtacgtccgttctttacgtagttcgtacccttacgtaacgttccgtaccgtacccgtaaaccggtcccggtacccccttacccgtaacccgggtaacctacccggtttcccgtaccccggggttaccctacccggaccgtacccgggttagggaaccgggtaacccgggtacggtacgttacgttaacgttttagtttaacgtttacggttaaacggtttactaagttaaccttaaaccgtaaaccccggtaaggtaccggttaaccgtttaaccgggtttgggggtaccggtttccggggaaccgggtaccggggaacgtacgggtaccgtccgggtaacccggtacgttacgggtaccgtaaccggtaccccgaaggtccccctcccggtaccccccggttcgtacccgttacccgttacccgttccccgttaccccgtaccccgttaccccgg

SEQ ID NO: 274537 - DNA, 867 bp, Homo sapiens
  misc_feature: GYAE6OF01ASL57.27.23.C01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtacacgtgattagggagttggggggggtctcagggaggcagcgctctcgggacgtctccacatggcctgggctctgctattcctcaccctcctcactcaggcacgagggtcctgggcccagtctgccctgactcagcctgcctccgtgtcgtgggtctcgtggacagtcgatccaccactctcctgcacgtcggaaccccgngatcggtacggtttgggtgttactttaacgttaacctttttagtccgttaggtttaccgggtaacccgtaccggaacgggaaccccgacgggtacccaaccgttaccggtaaccccccaaaacttaccctaactttttcctttaagtacggtaatcgttacgtaaacggttaaccgtccccgggttacccccggttaggggttttcctacgtacgttccggtccgttttactacgttcgggtcccttaacgtaacggttcggtacctaccccggtacctacccggtcccctcccgtaccggtaccctacgtacccggtccccgggtccttaccgaccggtccgtaggaccgggaaccggtgggtactaggtttaacttttaagtttacgttttacggtttaacgttaactaacgttaaccttaaacccgggtaacttacggttaacgttacccggttagggtttcggggttacgggttacccgggggacggggtaacgggttacccgtagggttcctaaccgggtacccgttaccggtacgtacggacccggacccggtacggtccccctaccgggtcccccgttacgacccgtacccgttccttaccccgggtccccttccccgtaccg

SEQ ID NO: 274538 - DNA, 812 bp, Homo sapiens
  misc_feature: GYAE6OF01BBZYX.27.23.C01.1.454.CMB.1.raw
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgccctcgtgtcgtgggtcctcctggacagtcgatccaccatcctccgtgcacgtcggaaccccgngattcggaccgtttgggtntacctttaattaacttttattccgttggtttacggtaacccgtaacgacgggtaccccgaaggccacctacgtacccccaaaccttctacttttactttagtgtacttcgtacgtaagttaacgtcccgggacccccgttagggtttcctgtattccgtctttctagtcggtcctacgaagttcctcgtacccttacgaccggtccccttacccgtcgtaacccctacgtcccgtaccgggccttccgaacgcccgttagggacggaccggacggtcgttacgttaagttttacgtttaagtttacggttacgtttacctaaacgttaaccctaaccgaaacccgtttaggtacgggtaaccgttaccgggttttaggggttcgggtttacggggaccggggtaacggggacccggtacgggtacccggtaccggtacccgggttaccgtaaccgggtacccgaaccggtccccggaaccggttcccgtaccccggtccccccggtaccggttccctaccccgttcgttcccccttacccccgtcccctaccccg

SEQ ID NO: 274539 - DNA, 818 bp, Homo sapiens
  misc_feature: GYAE6OF01CB215.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgngatcggtacgtttggtcgtactttaattaactttatcgttggtttcggtaaccgtacgacggtaccccagggtccaccgttaccggtacccccaaaacttccgacttttaccgttttaatcgtaattcgtactaaggttaaccgttcccgggacccccggttaagggggttttcctaggtaacgttccggtcttttaccgtagttacggtcccttaccgtaaacggttcctacggtacccctaaccggtacccggtccccttaccctacggaaccccttaacgttcccgggtacccggtccctacccgtacgtcccggtagggaaccgggaccgtaggttccgtagttaattttaagtttacgtttaggtttacgttactaacgttaactaaaccgtaacgtaggtacgttaaccgtggtttcggggtacggttccgggacggggtaacggtaccggtacggtcgttaaccgggtacccggtaccgtaccggtacgaacccggtacccgaacgggtccctaccccgggtcccccttacgggtccccttacgttcccgttacccgttcccccgaccccgttacccgg

SEQ ID NO: 274540 - DNA, 713 bp, Homo sapiens
  misc_feature: GYAE6OF01DJ2SG.27.23.C01.1.454.CMB.1.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctctcactcagggcacagggtcctgggcccagtctgccctgactcagcctgcctccgtgtctgggtcctccgtggacagtcgatccaccntcctcctgccacgtcggaacccgcgatcggacgtttggtntactttaacttaactttntcgttggttacggtaccgaacacggtacccaggcacctcgtaccccaaactctatttcttatgatgtactagtaacgtcccggccccgttagggtttcctgactcgtcgtttctagtcggcctacgtaacgtctcgtaccctaccgtaccggtccccttaccgtacgtaccctacgttcccggtaccccggtcctaccgaccgtcccggtaagggaacggacggtagttccgtagttaatttacgtttacgttagttaacgttacaattaactaaccctaaacgttacgtagtaaccgttagggtttacgggtcggttacgggacgggtacggaccgtaggtaccgtccgtaaccggtccgttagacccgaaccggaccgacgtccccgtccggtcccccgttaggtcccttaccgtcctttaccccgtccctaccccgtaccg

SEQ ID NO: 274541 - DNA, 683 bp, Homo sapiens
  misc_feature: GYAE6OF01D8NOM.27.23.C01.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggagttggggggggtctcaggaggcagcgctctcgggacgtctccaccatggcctggctctgctattcctcacctcctcactcagggcacagggtcctgggcccagtctgccctgactcagcctgcctccgtgtctggtctctggacngtcgatcaccagtctcctgcaccgtggaaccccngatgacgttggtntcttaataactttatcttgttcggtaccgacgtacggacccaggcactcgacccctaaatctattctttaactgtaatgtactacgtaacgtccggtaccccgtaggggtttcagtactcgtcttctacgtcggcctaccgtaagtctcgtaccctaccgaccggtccctaccctcggacctacgtcccgtcccgggtctacccgacgtccggtaggacggtacgtaggtcgttagttagttttaacttagtttaggttacttactattaaccgtacaaacgtagtcgttaacgttcggtttacgggtcggttacgggaccggtacgggttaaccacgggttctaccgggtaaccgtccggtaggtaccgaccggtacccgaaggtcccgtacccgtccccgtacgtacctaccttccttacccgttccctcccgtaccg

SEQ ID NO: 274542 - DNA, 706 bp, Homo sapiens
  misc_feature: GYAE6OF01ED5C0.27.23.C01.1.454.CMB.1.raw
  modified_base (232)..(232): a, c, t, g, unknown or other
  misc_feature (232)..(232): n is a, c, g, or t
  modified_base (293)..(293): a, c, t, g, unknown or other
  misc_feature (293)..(293): n is a, c, g, or t
  modified_base (371)..(371): a, c, t, g, unknown or other
  misc_feature (371)..(371): n is a, c, g, or t
  modified_base (434)..(434): a, c, t, g, unknown or other
  misc_feature (434)..(434): n is a, c, g, or t
  modified_base (699)..(699): a, c, t, g, unknown or other
  misc_feature (699)..(699): n is a, c, g, or t
tcagagcgtcgtctcacgaccggtgctcgatttagtacacgtgattagggagttgggggggggtctcgaggaggcagcgctcgtcgggacgtctccaccatggcctgggctctgctattcctcaccctcctcactcagggcacgagggtcctcgggccaggtctcgccctgactcacgcctcgccttcgtgtcgtggtcctcgtggacacgtcgactccacgtctccttccncgactaccggtacgacccgagtacgtcggtacggttggtcttactttaacttaacgttttntcgttaggtacggtaccgacgacgaccgtgacctacgtacccgaaccctaattacttctttacgttagtacgttaacncgttacgtaaaccggtaccggtcccggtaccgggttaggtttcaacgtccgttctacgttacncggtctaccgtacttacgtccgtccgaaccgttaccgccgtccctcggaactacccgtgtacccgtccgtccgtaccgtccgtacggacgacggtacgcggtacttaagttacttagttcgttagttactactactacgtaacgtacgtgtaacgtgttacggtacggttcggacggtacgtacgacggtcgtacgtcgtaccgtcggtacgcgacggtacacggtccctcccgtccgtactccgtacgtccgtaccttcccgtntacccgg

SEQ ID NO: 274543 - DNA, 870 bp, Homo sapiens
  misc_feature: GYAE6OF01D26VB.27.23.C01.1.454.CMB.1.raw
  modified_base (249)..(249): a, c, t, g, unknown or other
  misc_feature (249)..(249): n is a, c, g, or t
  modified_base (284)..(284): a, c, t, g, unknown or other
  misc_feature (284)..(284): n is a, c, g, or t
  modified_base (359)..(359): a, c, t, g, unknown or other
  misc_feature (359)..(359): n is a, c, g, or t
tcagagcgtcgtctcacgaccggtgctcgatttagtacacgtgattaggggagttgggggggggtctcgaggaggcagcgctcgtcgggacgtctccaccatggcctgggctctgctattcctcaccctcctcactcagggcacgagggtcctgggcccagtctcgccctgactcagcctcgcctccgtgtcgtcgggtctccgtggacagtcgactcaccactctcctgcctaccgtcggaaccccgngatcggtacgttggtagtactttaattaacttttntcgttaggttacggtaccacgacggacccaggtcctactccgtaacccctaacttcgttaacttttcgttttaancggtacgttacgtacgtaacggtacccgtccccgggtaccccggtttagggggttttacctcggttacgttcccggttacttttacgtacggtttccggtacccctaccgtaacggttcccgtaccgtacccccgttaaccgtcccccgggtaccctccccgttacgaaccccttcccggtccccggttaccccgggtccgtacccgtaccggtaccggtacggaccggggtaaccggtacgggttacttaagtttaacgttttaagttttacgttaggtttaacgttacttaacgttaacctaaaccgtaacgttaacggtaacgttccgggttacgggtttcggggttacgggttaccggggtacggggtaaccgggtaccggacggtccgttaccggtaccggtacccggttacggtaccggaacccggtccaaccgggtcccttaccccgggtaccccgtcggttaccctacccgttcccgttccccgttccccgtcccgtacccgg

SEQ ID NO: 274544 - DNA, 699 bp, Homo sapiens
  misc_feature: GYAE6OF01A6IBU.27.23.C01.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (478)..(478): a, c, t, g, unknown or other
  misc_feature (478)..(478): n is a, c, g, or t
  modified_base (508)..(508): a, c, t, g, unknown or other
  misc_feature (508)..(508): n is a, c, g, or t
  modified_base (647)..(647): a, c, t, g, unknown or other
  misc_feature (647)..(647): n is a, c, g, or t
  modified_base (659)..(659): a, c, t, g, unknown or other
  misc_feature (659)..(659): n is a, c, g, or t
tcagagcgtcgtctcacgaccggtgctcgatttagtacacgtgattagggagttggggggggtcgtcgaggaggcagcgctctcgggacgtctccacatggcctggctctgctattcctcaccctctcactcagggcacagggtcctagggcctaggtctgcctgactcagcctgcctcggtgtacgtgggtctactgggacagtcgatcacctatcctcngctacgtgggaaccccngatcgtacgttcggtactttataacttctctcggttcggtaccgacacggtaccgaaggtctacgtcgtacccctaaactcttaactttcttataggtacttgtacgtaggtaacgtcccggtccccgttaggggttttctaggtacttccggtactttccgtaaggtcgtacctacctaaggtccgtacgtccttaaaccgccggttccctacggtactaacgctccgttccgggtacncccgtaacgccgttacggacggtaaccggngggtactacgtattagttattcggtactaccgtataacgtacacgtaggttacgagttacgggtcggtagtcccgggagggtacgtaccgtagggacttaccggacgtaaccgttgggaccacggtcctagggtacccnccggttacccgngggttacctacgttcccggttaaccgcccttaacgcccgg

SEQ ID NO: 274545 - DNA, 722 bp, Homo sapiens
  misc_feature: GYAE6OF01DNES4.27.23.C01.1.454.CMB.1.raw
  modified_base (238)..(238): a, c, t, g, unknown or other
  misc_feature (238)..(238): n is a, c, g, or t
  modified_base (270)..(270): a, c, t, g, unknown or other
  misc_feature (270)..(270): n is a, c, g, or t
  modified_base (333)..(333): a, c, t, g, unknown or other
  misc_feature (333)..(333): n is a, c, g, or t
  modified_base (505)..(505): a, c, t, g, unknown or other
  misc_feature (505)..(505): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcacccctcctcactcagggcacagggtcctgggcccagtctgccctgactcagcctgccctccgtgtctgggtctccgtggacagtcgatcaccatctcctgcacgtcggaaccccgngatcggtacgttggtagactttaataactttntcgttgttacggtaccgacgacggacccaggcactccgtaccccaaactctattctttatgtntgtcgagtaacctccggccccgtagggtttctacgtactcgcttactagtcggactaccgaagtccgtacgaccctacgacccggtccctcccgtacgacctacgtccgtacccgggtcctacccgacggtccgtaagggacggaaccggcggtctagttaatttacgtttnttaacgttcgttactaagttaactaacccgtaacctaggtacgaacgttcgggtttagggttccgggttcggtacggggaacggtacccggtcgggtaccgtacggtacccgttaaccggtcggtaaccgtaaccggacccgtaacgggtcccgcccgtccccccggtaccggtaccctacccgttccgttaccccggttccccctccccgtacccg

SEQ ID NO: 274546 - DNA, 925 bp, Homo sapiens
  misc_feature: GYAE6OF01CLWX7.27.23.C01.1.454.CMB.1.raw
tcagagcgtcgtctcacgaccggtgctcgatttagtacacgtgattaggggattggggggggtctcaggaggcagcgctctcgggacgtctccaccatggccgtgggctctgctattcctcacctcctcactcagggcacgacgggtcctcgggcccaggtctcgccctgactcacgcctgcctccgtgtcgtgggtctccgtggacaggtcgatccaccattctccgtgccacgtacggaacccgtcgaagtggtaaccggtttgggtactacttttaacttaactttacgtcgttaggttacggtaaccgacgaacggacccgacggtactaccgtaccgtaaccctaaaccttctacttttactttaagacgtgttacggtacgtaacggtaccgtcccgggaccccggtttaggggtttctggtacttccgtcttacgttacggttcggtaccttacgtaagtccgttacgtacccgtaccggtacccgttcccgtacccgtacgtaacccgtcggttacccggtcccgggttacctaacccggtacggttacccggtacggggtaaaccggggaccggttaaacggtcggttttaacgtttaaaacggtttttacgtttttaacggtaacgggtttaaactttaacccgttaactttaaaaccggtttaaaccgtaaaccggtaaccgtttacggtaaacccgggttttccgggggtttacgggggtaaaccgggtcccgggggtaacggggtaacccgggtaaccggtaccgggtacccgaccggggtttaacccggtaggtacccggggtaacccgtccggggtaaccggaaccggttcccgtaaccccgggttccgttaccccgggtccgttaaccgtttccccgtaccccggttttaccccacccgggtttacccg

SEQ ID NO: 274547 - DNA, 789 bp, Homo sapiens
  misc_feature: GYAE6OF01ADFC7.27.23.C01.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattggggggggtctcaggaggcagcgctctcgggacgtctccaccatggcctgggctctgctattccctcaccctcctcactcagggcacagggtcctgggcccagtctgccctgactcagcctgcctccgtgtctgggtctcctggacagtcatcaccatctcctgacacgtggaacccngatgacgttggtcncttataaacgtttntctggttcgtaccgacacggacccaggcactcgtaccccaaactctatttctttagtcgaatcgtctaacgttaactcccgggtaccccccgtagggggttttctacggtacttccgtcgtttacctaaggttcggtaccttaccgtaaacgttccttacggacccccttaacgaacccggtccccgttcccccgtcgtaaccccgtaacgttcccgtccccggggtaccttccccgacggtacccgttaacgggtacggaccgtaacgggtcctttaggtaactttttaagttaactttggttaaactttccgaattaaacttacccaaaaccgtacggttacgtaaccgtaaccggttttggggtcggtttaccggggacgggtaacgggtaccgtaacgggtccgttccgggtaaccgtccccgttaaggtacccgaccggttacccccggaaagggttccctacccggtccccccggttacggtacccctcgtttaccctccggttcccccgaacccgttccccgg

SEQ ID NO: 274548 - DNA, 733 bp, Homo sapiens
  misc_feature: GYAE6OF01EGV0R.27.23.C01.1.454.CMB.1.raw
  modified_base (244)..(244): a, c, t, g, unknown or other
  misc_feature (244)..(244): n is a, c, g, or t
  modified_base (724)..(724): a, c, t, g, unknown or other
  misc_feature (724)..(724): n is a, c, g, or t
tcagagcgtcgtctcacgaccggtgctcgatttagtacacgtgattagggagttggggggggtctcaggaggcagcgctctcgggacgtcctccaccatggcctgggctctgctattcctcaccctcctcacgtcagggcacgacgggtcctgggcccagtctgccctgactcagcctcgaccttccgtgtcgtgggtctaccgtggacagtcgatcaccagtctcctgcacgtcggaacccgngatcggtacgttggtacgtctttaacgttaaccttttagtcgttaggttacggtaccggacgtacggacccctggtactaccgttccgtaacccctaaattccgttatttaccttttaggacgttacgttcgtacctaacggttaaccggtccccggtaccccggttagggttttccaggtaccgttccggtctttcgttaacggtcggtacctaccgaagtccgtacgaccctacggacccgtccctacccgtcgacgtacgtccggtccggcctaccgacgtcgtacggacggacgtagtgtagttattagttcgtacgttatacattaacacgaactggtactaacgttcggttacggtcgggtaaccggcgggtacggaacgtcggtacgtaccgtaccggttccgtaacggtccgacggtaccggaacgtccgaccccggtccgtacccgggtaactcccgtattcccgttcccnccgttaccg

SEQ ID NO: 274549 - DNA, 812 bp, Homo sapiens
  misc_feature: GYAE6OF01E5I35.27.23.C01.1.454.CMB.1.raw
  modified_base (141)..(141): a, c, t, g, unknown or other
  misc_feature (141)..(141): n is a, c, g, or t
  modified_base (261)..(261): a, c, t, g, unknown or other
  misc_feature (261)..(261): n is a, c, g, or t
  modified_base (393)..(393): a, c, t, g, unknown or other
  misc_feature (393)..(393): n is a, c, g, or t
  modified_base (454)..(454): a, c, t, g, unknown or other
  misc_feature (454)..(454): n is a, c, g, or t
  modified_base (634)..(634): a, c, t, g, unknown or other
  misc_feature (634)..(634): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacgngggtcctgggcccagtctcgcccgtgacttcacgtcctgcccgtcgtgttcgtagggttctccgtgggaacctgtcgactcaaccgtattcctccgtagcctaccgtccgggaaccccgngtacgtgggttaccggtttgggtctactttttaactaaaccttttttcttacgtcggtttaccggtaaccgaccgtaaccggaacccgtgggacctaccgtcccgtaaccccaaatttctacgtttactttncgtattgaacgtacggtacggtcccgtcccggttagggttcctaggtacgttctccgtttntacgtcgacctacgtacgtccttacgaccctaccggtcccggtaccctcccgtaacggtaccctcgtttcccgtaacccggcttaccggaccgtcccggaaggaccgggtacgtaggttactcgtttaagtttagttttcgtttaaggtcttactaaattaccgtaaacgtacgtaacgngttaccgttaacgggttcggtacggtcggggacccggtagggtaccgtcgggtaaccgttacccggttaccgtaccggtccgttaaccggacggaccccttaccgggccccgttcccggttaccccccgttgacccttccccggttacctttaccccgggtcccctaacccgttcccg

SEQ ID NO: 274550 - DNA, 731 bp, Homo sapiens
  misc_feature: GYAE6OF01DPB25.27.23.C01.1.454.CMB.1.raw
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
tcagagcgtcgtctcacgaccggtgctcgatttagtacacgtgattagggattgggggggggtctcaggaggcagcgctctcgggacgtctccaccatggcctggctctgctattcctcaccctcctcactcagggcacagggtcctgggcccagtctgccctgactcagcctgcctcgtgtcgtgggtctccgtggactagtcgatccaccatcctcctgcctacgtacgggaacccngatggtacggttgggtatactttattactttntcgttggttcggtaccgacgaccggaccaggccacgtaccgtaccaactctatttcgtttatgtatcgtactaagtacgtcccggtacccgttagggtttccagtctccgtcttcgtacgtcgtacctacgtaagttctacgtaccctaaccggccggtcccctaccgtacgtacctaccgttccggtacccggtctaccgtaccgccggttagggaccggacggtacgtcgttaacgttaattttacgtttaagttcggtttaagttaccaacttaaccgttaacaacgttagtacgttaacggttacgggttacggggttcggtacggggacgggtacggacgtcggtaccggtacggtacccgtcgttacggaccgtaccgggacgtaccgtcccgacccggtccccttacgggtacccttaccgtcccggttacccggtcccccgttccgtacccg

SEQ ID NO: 274551 - DNA, 1060 bp, Homo sapiens
  misc_feature: GYAE6OF01ERG7N.27.23.C01.1.454.CMB.1.raw
tcagagcgtcgtctcacgaccggtgctcgatttagtacacgtgattagggagttggggggggtctcaggaggcagcgctctcgggacgtctccaccatggcctgggctctgctattcctcaccctcctcactcgagggcacgacggtcctcgggcccagtctcgccctgactcagcctcgtcccgtcgtgtcgtcggtcctccgtggactcgtacgactcaccatccttcgtcgacctaccggtaccggaaccgtagtacgttcggtacggtttggtacgtacttttaaacgtttaactttacgttcgtttacgggttaaccggtacccggtaacggaacccggtaccgtaacggtacccgtaaccgttaccccggttaacccctaaacctttccgtttaaccgtttttacgtttaacggtacttaaacggtttccggttaacccgtttaaacgggttaaccccggtccccccgggtttaacccgggttttacggggttttaacgtacccgtttaaacccgttttccgggttacccttttaacggtaccggtttccgggtaaaccccttaacccgggttaacgttcccgggttaacccggtaaccccgttaaccccggttacccggtacccccttaaccgggtaacccgttaaccggtccggttcccccgggtaaccccggtccgtacccgtcgggtacccgttaacggggaacggtaccggtacggttacgtttaacgtttaacgttttacgtttaacggtttacggtttaacgttaaaccgttaaacttaacccggttaacgtaaacggtttaccggaccggtttaacgggttttaccgggtaccggtttacggggtaaccggggaaccgggggttacacccgggttacgggttccgttaacccggggttacccggtttaaaccgggttcggaaacccggttacccgggtacccgggtaacccgttccccggtttccccgggaaacccccgtttacgggttcccgttaaccccgtttacccggtttccccccgttcccgtaaccccgttaacccgggg

SEQ ID NO: 274552 - DNA, 942 bp, Homo sapiens
  misc_feature: GYAE6OF01EHXLY.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctcgccctgactcagcctgcctcgtgtctgggtctccgtggacagtcatcaccatctcctgcacgtcggaacccgngatgtacggttggtgtactttaattaactttatcttggttacggtaccgacgacggacccaggccaccttaccgtaacccctaaactcttactttactttatgtattgtactaagttaccgtcccggtaccccgttagggtttctcgtacgttccgtctttacgtacgtcggtcccttaaccgtaacgttccgtaccgtaccccgtaaccgcccggttccccttacccgtaccgtaacccgtaccgtttcccggtccccgggtacccttacccgaacggttcccggtaacggggaacgggtaaccgggtacggttaccgtttaaggtttaaacgttttttaacgttttacgtttttacgggtttaacgtttaactaaacgtttaaacccgtaaacccgtaaaacccggttacggttaaccggttaaacccggttttacgggggttttacgggggtttacccggggttaaccggggggacccgggggttaaaccgggtacccgggtaacggggttacccggttaaccccgggttaacccggtttacccgggtaaaccgggttcccggtaaaccccgggtaaccccgggttaaccgggtcccccggtttaacccccgggttaccccccggtttacccgggttaccccttaaccccgttttacccccggtttcccccgtttaaacccccccgtccccggtttaacccccgg

SEQ ID NO: 274553 - DNA, 783 bp, Homo sapiens
  misc_feature: GYAE6OF01DIFH4.27.23.C01.1.454.CMB.1.raw
  modified_base (759)..(759): a, c, t, g, unknown or other
  misc_feature (759)..(759): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctctcactcagggcacgagggtcctgggcccagtctcgcctgactcacgtcctcgcctccgtgtcgtcggtcctccgtggacagtcgactcaccactccgtcctcgacctaccgtaccggaacccgcgtacgttcggttacggttcggtacttacgtttaaacttacgtttactcggtttacggttaacccggaccgtaacgaaccggaccgtacggacctacccggttaccgtaaccccctaaaatcttttaagtttaccgtttagacgttacggtacgttaacgtaacccggtttacccggtacccggggttcccggtttaagggtttccgtacgtccgttcgtttacgtcgtacgtcgtacctacgtactcctacgtcccaaccggtcctaccaccgtcgcctacggttcccgaccgactcgacgtcgaacggcggtactgtacgtattactttacgttagttagtactaactagtaactaaccgttagacgttacgtacgttaagggttccgggttaggtaccggacgggacgtaaccgtcggttaccctaccggtacgttcggaaccgttaccggaccgtaccggcccggtcctacccgggttcccgtaacttaccccgtctttaaccccncccttaaccccgggtcctaacggg

SEQ ID NO: 274554 - DNA, 863 bp, Homo sapiens
  misc_feature: GYAE6OF01AHKPK.27.23.C01.1.454.CMB.1.raw
  modified_base (233)..(233): a, c, t, g, unknown or other
  misc_feature (233)..(233): n is a, c, g, or t
  modified_base (266)..(266): a, c, t, g, unknown or other
  misc_feature (266)..(266): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctcgccctgactcagcctgcctcgtgtctgggtctcctggacagtcgatccacatcctcctgcactcggaacccgngtatgtacggttggtgtctttaagttaactttntcttggttgtaccgacacggacccaggcactccgtacccctaaactctactttcttttatgtagttcgtaccgtaacggttaaccgttcccgggtaccccccggttagggggtttccttcggtacgttcgttcctttacgttagtcggtccttaccgtaacgtccgtacgacccttaccggaccgtcccgttcccctacgtaacccgtcgtcccggtacccgggccctccccgtaggtacccgtacggggaacgggtacggacgttacgtacggtttactttacgtttacgtttagttacgtttacctaacgtttaaccgtaacccgtaaacgtaaccgggttacgtaacccgtttaccgggttttagggggttacccgggttacccggggggtacgggaaacccgggggttaccggtacggggttaaccccggttaacccgggttaccccgtttacccgggttaaccgggtaccccggtaaaccccggtcccggtaaccggtacccccggttcccccggtacccccggttacccggttaacccggtacccgttaccccggtttcccccggttcccccggtacccccgttaacccgg

SEQ ID NO: 274555 - DNA, 707 bp, Homo sapiens
  misc_feature: GYAE6OF01C5Y98.27.23.C01.1.454.CMB.1.raw
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgacgggtcctgggcccagtctcgccctgactcagcctcgcctccgtgtcgtgggtcctccgtaggacagtcgactccacctatcctctcgcacgtaccgggaaccgcgtagtcggacggtttggtacgtactttaacttaactttgttcgttgggtttaccggaaccgacgacggaacccgnggtacctacctacgtaaccccaattctactttacttangtactcgtacgtaacggtacctcccgggtaccggttagggtttcacgtacgttccggttcttcgtacggtccgtccgtaacgtagtccgtacgtaccctaccgacccggtcctaccgtacgacctcggttccggtccggtcctacgcgtcgacgggacgtcgacgtcttagtactttattgttacgtacgttaacacgttaacaaccgtaagtgtacgtacgttacgggttcgggttacgcgggacgggtacgacgacggtaccgtacggccgtacgtacggccgaaccggacgtacggcccgtcccgtcccgtagtccctacgtcttccccgacctacccggtcg

SEQ ID NO: 274556 - DNA, 933 bp, Homo sapiens
  misc_feature: GYAE6OF01DWXTQ.27.23.C01.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
tcagagcgtcgtctcacgaccggtgctcgatttagtacacgtgattagggagttgggggggggtctcaggaggcagcgctcgtcgggacgtctccaccatggcctgggctctgctacttcctccaccctcctcactcgagggcacgacgggtccgtcgggcccagtctcgccctgactcgacgcctcgcctcgtgtcgtggtctcgngactgtcatccactntcctctgaccacgtaccggaccgngtacgtggtacggttggtctactttaacttaactttgtcgttacggtacggtaaaccgacggtaccggaaccgcggtacctaccggttaccccgtaaaccccttaaacttcctttaacgttttaccgtttagacgtttacgttcggttaaacaaaccgggtttacccggtccccggggttaacccgggttttagggtttacgacgtttaccgtccggtttactttacggtacggttacccggttacctaaccggttcgttacccgtcctaaccccggtaacccgtccccgggttaccctacccccgtacgaacccggttcccggttcccgggtaccccggtactacccggtccggtacggtacgggacgggtaccggtacgttaacgttagtttaacgttttacgtaaggtttacgttaaccttaacgttaacttaaccaccgttaagtaccgtacggttaccgggtttacgggttacggtacggggttaccggggaccgggttaaccggtacggtccgggttaaccgtaaccggttacccgggttaccggtaaccggtacccggttaaccccggtaccggggttaaccctcccccggtttaccccccgggtccccggttaccccggttaacctttcccccggttaacccccggtttccccccgttccccgacccgtttaccccggg

SEQ ID NO: 274557 - DNA, 659 bp, Homo sapiens
  misc_feature: GYAE6OF01A8RK3.27.23.C01.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatctcctgcacgtcggaacccgnatgtacgttggtntactttataacttttatcttggttcggtacccgacgtacggacccaggcctaccgtcgtacccccaatctatttctttatgtatcgtacagtaacgtccggtccccgttaggggtttctagtacgtcgtcttcgtagtcggtacctaccgagttcgtcgtaccctacgccggtccctccgtcgacctcgtccgtccgggtcctccgactccggtagacggtacgacggtctagtactttagttagttcgttagtacattactaaccacgtagtacgtagttacgggttgggtacgttccgggacgggacggtaccgtagggtctaccggtctacggtacggtccgaccggtaccgacggtcctcccggtccccgttcggtccctccgtccttccgtcccccgtccgtacccg

SEQ ID NO: 274558 - DNA, 723 bp, Homo sapiens
  misc_feature: GYAE6OF01EV3AN.27.23.C01.1.454.CMB.1.raw
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggccagtctgccctgactcagcctgcctcgtgtctgggtctcctggacagtcgatcacatctcctgcacgtcggaacccngactggacgtttgggtctctttaattaacttttntctgttggtaccgacacggaccaggcactcgtaccccaactctactttctttatgtaatcgtcaagttaaccgtcccgggtacccccggttaggggtttactggtacttccggttactttcgtagttcggacctacgtaacgttccgtacgtccctacgccggtccctacccgtacgacctacgtccggtcccgggtcctaccgtaccgccgttagggaacgggtacgggtacgggtccttaggttaacttttacggtttaagtttacggttaacgtttactaaagtttactaaaccgaaccgtagttacggtaacgttaacgggttcgggttacgggttcgggacggggtcggaacgtcggtactaccgtaccgttaccgaggtccgaccgtaccgaacgggtcgtccccggtcccgaccggttcctccggttacccttccgtccccctcccgtacccg

SEQ ID NO: 274559 - DNA, 864 bp, Homo sapiens
  misc_feature: GYAE6OF01CC86A.27.23.C01.1.454.CMB.1.raw
  modified_base (256)..(256): a, c, t, g, unknown or other
  misc_feature (256)..(256): n is a, c, g, or t
  modified_base (430)..(430): a, c, t, g, unknown or other
  misc_feature (430)..(430): n is a, c, g, or t
tcagagcgtcgtctcacgaccggtgctcgatttagtacacgtgattagggattggggggggtctcaggaggcagcgctctcgggacgtctccaccatgcctgggctctgctattcctcaccctcctcactcagggcacagggtcctgggcccagtctgccctgactcagcctgcctcgtgtcgtgggtctccgtggacagtcgatccaccatcctcctgacctacgtcggaaccccgcgtagtcggacggtttggngttaccttttaattaaaccttttgttcgtttggtttagggttacttggaaccgacggtaaccccgaggtacccaaccttaccggtaaccccctaaaacttccttaacttttcgttttatagtattcggtactaacggttaaccgtcccgggtacccccggttggggttttaccnggtacgttccgtcgttacttgtcggaccttacgtaacgtccgtacgtaacccgtacccgccgggtacccctttacccgtacctaccgaacccgttccccgggtcccgggtacccgtaccgacccggtccggtaacggggtaacccgggtaacgggtacggttaacgttaagttttaacttttaaagtttacgttttaaggttacctttaaagtaacttaaaccgttaaaccctaacggtaacgtaaccggtaacggtttacgggtttcgggggttaccggttacggggtaaccggggtaccgggaccggtacggggtccgtaccggtacccggtacgtacccggtaggacccgtaacggtacccgggtacccgtcccggtaacccccggttcggtacccgttaaccctccccgtttcgttaccccctacccccg

SEQ ID NO: 274560 - DNA, 670 bp, Homo sapiens
  misc_feature: GYAE6OF01BEXQO.27.23.C01.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
  modified_base (355)..(355): a, c, t, g, unknown or other
  misc_feature (355)..(355): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacagggtcctgggcccagtctgccctgactcagcctgcctccgtgtctggtctcctggacagtcgatcaccatctcctgcactcggaacccgngatggtacgttggnctttataactttntcgttgttcggtaccgacacggaccgaggctactcgtaccccaactctactttctttangtatgttacagttaactcccggaccccggtagggtttcngacttcgtcttctagtcggtcctactaaggttcctacgaccctacgaccggtccctaccgtcgaacctcgtccgtccgggctaccgcgtacccgtggaacggtacgacgggtctacgttatttagttagttgttacgtactattaacgtacaacgtgtacgtacgtacggtttgggtccgttacgggacgggacgtaccgaggtcgtccggtaaccggttccgtaaggtaccgaccggtacccgaaggtccccgtaccggtccccccggtagttaccctacgttcccgttacccgttccccgtcccgttaacccg

SEQ ID NO: 274561 - DNA, 866 bp, Homo sapiens
  misc_feature: GYAE6OF01DKV72.27.23.C01.1.454.CMB.1.raw
  modified_base (246)..(246): a, c, t, g, unknown or other
  misc_feature (246)..(246): n is a, c, g, or t
  modified_base (563)..(563): a, c, t, g, unknown or other
  misc_feature (563)..(563): n is a, c, g, or t
tcagagcgtcgtctcacgaccggtgctcgatttagtacacgtgattagggagttggggggggtctcaggaggcagcgctcgtcgggacgtctccaccatggcctgggctctgctattcctcaccctctcactcagggcacagagtcctgggcccagtctgccctgacctcagcctgcctccgtgtcgtgggtcctcgtggacagtccgatccaactagtctcgtaggctacgtacgggaaccccgngtatggtaccgttgggactactttaacttaagtttcgtcgttacggtttacggaaccgacgtaccgggaaccacgggacctaccgtaccgtaaccccctaaattccttaaattttccgttacgtagtacgttcggtaactaacgggtttaaccgtccccggttacccccgggtaagggtttccgtagtaccgtttactccgttacgtaacgtgtacccgttaccgtacgtaccgttccgacccgttaccgtaccccggtcccgttacccgtaccaccgtacgttcccggcccgttaccgcccgtaccggttacccgnggaaaccgggttaacggacggttacgtaggttaaaccttttaagtttcgtttacggttaaacgtttaccaactttaacggtaacccaacgtttaacgccggtaacttaccggggtttagggttccgggtaaccgggacggggtaacccgaaccgggtacggttaaccggtaccgggttaacccgtaccggttaacggtcccgaacgggtaccccttaaacgggtcccggttaccccgaacccccgggtttcccgttacccgttaccgttacccccggttcccggttaccccccgtaaccccgg

SEQ ID NO: 274562 - DNA, 852 bp, Homo sapiens
  misc_feature: GYAE6OF01B9SVI.27.23.C01.1.454.CMB.1.raw
  modified_base (251)..(251): a, c, t, g, unknown or other
  misc_feature (251)..(251): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgccacgtcgggaacccgtgatggtacgttggntacctttaagttaacttttatcgttaggttcggtaaccgacgacggacccaggcactacgtacccctaaatctatttctttatcgtattcgtactaaggttaacgtccccgggtaccccgttaggggttttccaggtacttccggtactttacgtagtcggacctaccgtaagttcctacgtacccgttaccgacccggttcccctacccgttacggaccctacgttccccggtcccgggtaccttaccccgaggtcccgttagggaaccgggaacggtacgggtacctttaaggttaatttttaagtttacgtttacggttacgtttaacctaaatttaaccgtaaaccgtaaaccgttacgggtacgttaaccgtttaaccggggtttggggttaccgggtttaccgggggaaccggggtaaccgggtacccggtacggtccggttaaccgggtacccccggtttaggtaaacccggggttccgaacccgggtacccggggtaaacggttccccggttacccccgggttacccccccgttacgggttaccctacccgttttcccggttacccctttaccccccgtaccccgttacccgg

SEQ ID NO: 274563 - DNA, 856 bp, Homo sapiens
  misc_feature: GYAE6OF01D8E6T.27.23.C01.1.454.CMB.1.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggagttggggggggtctcaggaggcagcgctcgtcgggacgtcctccaccatggcctgggctctgcttattcctcaccctcctcactcagggcacgaggtcctcgggcccagttcctcgccctgactcacgcctgcccttccgtgttccgttcgggtccttccgtagggactacggtccgtactaacccncctaccgttcctccgtanaccgaaccgttaccccggggaaacccctgtaagtacggttacgggtttcgggtccttaacttttaaattttaaaccgttttcgtcggtttacgttaccggaaccgtaccgacggaaccccgtacggaccttaaccgtacccgtaaacccctaacgttaccttacttttacgtttatacggtttactacgttacgtaacgtaaccccggtacccgggttccccgttagggttttacctactacgttccgttaccgttacgttacgttcggtacccgttaaccgtaggttacccggttaccgtacccgtaaccggtccccgtaacccttcccgggacccttaaacgtccggtttcccggaccggtcccgtacccgtacgccgtaacgggacggtaacgtacggtacttagtacttttaagttagttaccggttatacgttaagtaccctaaagtacacgacgttagtacgttagggttacgggtacgacgggttaccgagtaccggtagttaccgtaccgtcggtacgtaaccgccgtaaacccggctaccccggtcccgtaccgtccgtacccttacgttcccgtccccgtccgccctacg

SEQ ID NO: 274564 - DNA, 678 bp, Homo sapiens
  misc_feature: GYAE6OF01DIC4X.27.23.C01.1.454.CMB.1.raw
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
  modified_base (626)..(626): a, c, t, g, unknown or other
  misc_feature (626)..(626): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcaggcacgaggtcctgggcccagtctgccctgactcagcctgcctccgtgtcgtgggtctccgtggacagtcatccactatcctcctgcactcggaacccngagtgacgttggcgtacttattaactttatcgttggttacggtaccgacgacggacccaggcctactccgtacccaatctatttccttagngatgtacagtaaccgtccggcccgttgggttacgtactcgacttgtacgtcggtacctacgtacgtcgtaccgaccctacgacccgtcccgtaccaccgtactacttcccggaccggtcctaccggtcgaccgtaggacggtacggtagtccgttaagttactttaagttacgttgttacgtaactaagtaactaactacgtagtaacgtacgtagggtttcgggaggttccgggaacgggtacgcgtacgggtctccggtaccgtacggtacgacgaccgtaaccgacggaccgttccccnccccgggttattacccgtacgttccgttccccgttaccccgcccttacccgg

SEQ ID NO: 274565 - DNA, 898 bp, Homo sapiens
  misc_feature: GYAE6OF01BY0P4.27.23.C01.1.454.CMB.1.raw
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcgatccacctatctcctgcacgtacggaaccccgcgtaagtgacggtttgggtacgtacttttaattaaaccgtttttagttcgttgggtttacggtaacccggaaccgtaacgggaccccgagggacctaacctaccgttaaccccctaaaaccttccttaatttttaccttttaacgtcgtaagttcgtacgtaacggttaaccgtccccgggtacccccgttaggggttttcctagtcttccgtctttcgtacgtccggtaccgtaccgtaacgtctaccgtcccgtacccgtaccggtccccctcccgtacgtaccctaccgttcccggtcccgggtacctacccgtacggtaccgtacgggaacgggaaccggtacggtacgttacggttaacgttttaacgtttaagtttacggtttaacgtttaacgtaacgttaaccttaacccgtaacgtacgtaccggtaacgtttacgggtttacggggtttcgggttaccgggggtaacggggtaccgggtaccggtacgggtacccggtaccggttacccggttaacccggttaaccgggtacccggtacccgggtacccggtaacccggggtccccgttaccccggttacccccggttacccgggtacccgtttaacccgttccccggtttccccggttacccccccgggtcccttacccccgg

SEQ ID NO: 274566 - DNA, 824 bp, Homo sapiens
  misc_feature: GYAE6OF01DTDDR.27.23.C01.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctctcactcagggcactagggtcctgggcccagtctgccctgactcagcctgcctcgtgtctgggtctctggacagtcgatcacatctccngcacgtcggaacccngatcgacgttggnactttataactttntctgttggtaccgactacggacccaggcacgtccgtaccccaaatctactttctttatgtattcgtcaagtacgtccggaccccgttaggggtttctggtactcgtcttagtacgtcggcctaccgtaaggtcctcgccctacgaccggtccctccgtagaaccctctaccggtcccgggtacctacccgtacgtaccggtacggacgggtaaccggtacggtaccttaggttaacgttttacctttagttttacggttaaccggttttactaaccgttaaacttaacccgaaccgttaacgttacgtaaccgttacgggttttacggggttacgggtttaccgggggtaccgggtaccggggtaacccggtacgggttacccgttaaccgggttacccggttacccgggttaaccgggttacccggtaaaccggggtaaccccgggttaaaccgggtccccggttaaaccccgggtccccccccggtttaacgggttacccccgttaacccggtttccccgtttaacccccgggtttcccccccggttcccccgtttaaccccccggg

SEQ ID NO: 274567 - DNA, 894 bp, Homo sapiens
  misc_feature: GYAE6OF01E21AD.27.23.C01.1.454.CMB.1.raw
  modified_base (238)..(238): a, c, t, g, unknown or other
  misc_feature (238)..(238): n is a, c, g, or t
  modified_base (274)..(274): a, c, t, g, unknown or other
  misc_feature (274)..(274): n is a, c, g, or t
  modified_base (403)..(403): a, c, t, g, unknown or other
  misc_feature (403)..(403): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgccctccgtgtccgtgggtcctcctggacagtcgatcaccatctcctgcacgtcggaaccccgngagtggaccgttggtctactttaacttaaacttttntcgttgttcggtaaccgacgacggacccaggccacgtccgtaccccaaactctactttactttacgtgattgtactaacgtaacgtcccgggtcccccgttaggggtttcacggtacttccggtccttntacgtggtacccttacgtaacgttccgtacgtacccgttaccggaccccggtcccttcccccgtacgaacccgtacgttccccggtcccgggtaccctaccgtaccggtcccgtagggtaacgggaccggtaacgggttcttacggttaacttttaacgtttacgggttttaacggtttaacgttaacccgtaatttaaacccgtaaaccctaacccggttacggttaaccggtaaaccgttttaaccggggttttagggggttaccggggtttaacccggggacgggggtaaacccggggttaacccgacggggttaccccttaacggggtacccccgtttaaccggttaacccggggtaacccggaccccggtaaccccgggaaccggttccccggtaccccggttcccccccggtttacggtacccccgtttacgttacccccggtttccccccggttttacccccccgcccccggttttaaccccgg

SEQ ID NO: 274568 - DNA, 687 bp, Homo sapiens
  misc_feature: GYAE6OF01ENUCW.27.23.C01.1.454.CMB.1.raw
  modified_base (233)..(233): a, c, t, g, unknown or other
  misc_feature (233)..(233): n is a, c, g, or t
  modified_base (354)..(354): a, c, t, g, unknown or other
  misc_feature (354)..(354): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatcctcctgcactggaaccccgngatgacgttggtgtacttaataactttatcgtggttacggtaccgacacggacccaggcactcgtaccccaatctatttctttagtgtatgtacagtacgtccggaccccgtggggtttcnggtactcgtcttcgtagtcggctacgaacgtcgtacgtccctacgccggtcccttcccgtacgaccgtacgtccgtcccgggtccaccgtacgccgtagggacggcggaggtctaggtatttagttagttgttattacaattacctaacaactagtcgtaacgtacgggtttgggttgggttaccgggcgggtaacgggtacacgggttcgtaccgtaaccggttccgtaggttacccaccgggaccctaacgggtcccgtccccgggtccccccttacggggttccctacccgtttcccgtttcccccggttccccctccccgttaccccgg

SEQ ID NO: 274569 - DNA, 751 bp, Homo sapiens
  misc_feature: GYAE6OF01BA3UK.27.23.C01.1.454.CMB.1.raw
tcagagcgtcgtctcacgaccggtgctcgatttagtacacgtgattaggggagtgggggggggtctcaggaggcagcgctctcgggacgtctccaccatggcctgggctctgctattcctccaccctcctcactcagggcacagggtcctgggcccagtctgccctgactcagcctgcctccgtgtcgtgggtctccgtggacagtcgactccacctatcctccgtgaccaccgtcgggaacccgcgtacgtcggtacgttgggtacgtctttaataactttactacgttacggttaccggtaccgacgaccggaccgacggtcctaccgtacctaacccctaattcttactttcttagtgtacgtcgtacgtaacgtaccgtcccgggtacccggttagggttcctacgtacgttcgttcgttacgtcggtcgtaccgtaccgtacgtccgtaccgtacccgtaacggcccgtccctacccgacgtaccctccgtcccggtacccgtcctaccgtacggtacggtacggacgggtacgtacggttagttagttagtttaacgtttagttacgttaacgtactaacttaaccgtaacgacgtacgtacgtaccgttacgggttacgggtcgggtaccgggcgggtacggacggtacgtacgtaccgtaccggtaccgtaacggtccgacgtaccggacggtcccgtcccggtcccgtcgtaccttcccgttaccgtccctcccgtccctcg

SEQ ID NO: 274570 - DNA, 912 bp, Homo sapiens
  misc_feature: GYAE6OF01DXDQ3.27.23.C01.1.454.CMB.1.raw
  modified_base (241)..(241): a, c, t, g, unknown or other
  misc_feature (241)..(241): n is a, c, g, or t
tcagagcgtcgtctcacgaccggtgctcgatttagtacacgtgattagggagttgggggggggtctcagggaggcagcgccctcgggacgtctccaccatggcctgggctctgctattcctcaccctcctcactcagggcacgagggtcctgggcccagtctcgccctgactcagcctgcctcgtgtcgtgggtcctccgtggacagtcgatcacctatctacctgcacgtcggaacccgngtagtacggaccgttgggtactactttaacgtaaacttttacgtcgtttacggtttacgggtaacccggtacgaaccgggtacccaagggtcccttaaccgttaaccggttaaccccccctaaaagttccttaaacgttttacccgtttaaagtggttaacgttcggttaaccgtaaacgggtttaaacccgtccccgggtaacccccggttagggggttttacctacggtaaccgtttccggtactttacgtaaggttccggtaccgtacctaaacggtcgtccgtaccctaacccggtaccgtccccgtcccgttaacgtaacccgtacggtacccggtacccgggtacctaccccggaggttcccggaaggtaaccgggtaacgtacggtacgttaacgttaagttaacgttttaactacggttaacgttactaaacgttaacctaaccctaaacggttacgttacgtaaccggttggggtttaccgggtacggtaacccgggacggggtaaaccacccgggtaggtacccgttacggtaacccggttaccggtacggaacccgtaccggtacccggtaaacggtccccggttaacccggccccgttacgggtacccttacggtttaccccgtaccccgttaccccgccccgtttaaccgggtaaccg

SEQ ID NO: 274571 - DNA, 725 bp, Homo sapiens
  misc_feature: GYAE6OF01ELQGR.27.23.C01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccccngatggacgttggngtactttataactttntcgttgttcggtaccgacgacggacccaggcactacgtaccccaaattctactttctttagtcgtattcgtactaacggtaacgtcccgggtaccccgttaggggtttcctgtacttcgtcttctagtcggtcctaccgaagttcctacgtccctaaccgccggtcccttcccgtacgtaccgtacgttcccgtacccgggtaccctccgacggtaccctacggaacgggacgtacggtcttaagttaatttacgtttagtttacgttacgttactaacgttaactaacctaaccgtagttcgtaaaccgttcggtttaggggtcggtttacgggaccgggtacgggtaccgacggtaccgtacggtacccggttaccggtacggtccgaccgtacccggaacggtcccgtcccgtcccccgttacggtaccttaccctccgttacccttccccgacccgtccg

SEQ ID NO: 274572 - DNA, 778 bp, Homo sapiens
  misc_feature: GYAE6OF01D05H7.27.23.C01.1.454.CMB.1.raw
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (424)..(424): a, c, t, g, unknown or other
  misc_feature (424)..(424): n is a, c, g, or t
  modified_base (763)..(763): a, c, t, g, unknown or other
  misc_feature (763)..(763): n is a, c, g, or t
tcagagcgtcgtctcacgaccggtgctcgatttagtacacgtgattagggagttggggggggtctcaggaggcagcgctcctcgggacgtctccaccatggccgtgggctctgctattccctcaccctcctcactcgagggcacgacgggttccgtcgggcccagtctcgccctgacctcacgcctcgtccctcgtgtcgttggtcctcgnggacngtcgactaccacctatcctaccgtgccgtaccggtaccgggaacccgcgtacgtggtacggttggtacgtaactttaacttaacgtttgttacgttagttacgggaacctaacgaaccggtacccgagacctaccgtccgtaaccctaatcttactttcttagtgtagtcgtacgtaacgtaccgtccccggtccggtttaggtttcncgttacgttccgttattaccgtaggcccgtataaccgtcgtactccgaccctaccgtccggtccctaccgtacgaccgtcgtacccgtaccgccttagccgttacggacggtagacggtgttacgagtttaattttggtacgtttacggtactaacttaacgtaactaaccgtaacggtaggttacttacgggtttaacggttgggttaccgggttaccggacgggtaaccgtaggacccgttacgacccggttaccgttaccggacgtacccggtaacggccgttaccggcccgttaccccgtaccgtcccggtactacccgttccccgggttccccnccgttccccgtaacg

SEQ ID NO: 274573 - DNA, 827 bp, Homo sapiens
  misc_feature: GYAE6OF01BAL4F.27.23.C01.1.454.CMB.1.raw
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtcggaaccgcgatgtacggttggtnactttataactttntcttggttacggtaacccgacgacgggtacccgaggtaccncgttacgtaaccccctaaacttcgttactttccttttaatgtattcgacgtaagtacgttcccgggaccccgttagggtttctagtacgtcgtcgttctagtcggtcctacgtacgtcctcggtaccctacgtccggccccttccgacgtaccctaccgttcccggtcccgggtccctaccgtacggtcccgtagggtaacggcccgttaagggcctttagtaattttacggtttagtttcgttacgttaacttaacgttaaccaaccgtaaacgtacggttccgaaaccgttttccgggttagggggtttaccgggtacggggtaaccggggtacgggtaaacccgtccggggtacgtacccccgggtaaccgtttccccggtaaaggggttccccggtaacccgtaaacccccgggtaaccgggttccgttcccccccggggttaccccccgtttaggtaccccccgtttacccggtcccccgttttacccggttcccccccgggtaccccctttacccggg

SEQ ID NO: 274574 - DNA, 816 bp, Homo sapiens
  misc_feature: GYAE6OF01A5GTI.27.23.C01.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (367)..(367): a, c, t, g, unknown or other
  misc_feature (367)..(367): n is a, c, g, or t
  modified_base (404)..(404): a, c, t, g, unknown or other
  misc_feature (404)..(404): n is a, c, g, or t
  modified_base (508)..(508): a, c, t, g, unknown or other
  misc_feature (508)..(508): n is a, c, g, or t
tcagagcgtcgtctcacgaccggtgctcgatttagtacacgtgattagggtagttggggggggtctcaggaggcagcgctcgtcgggacgtctccaccatggcctgggctctgctattcctcaccctcctcactcagggcacagggtcctggccagtctcgccctgactcacgtcctgccctcgtgtcgtcgggtccttccgtaggactaggtccactcaaccnttcctccgtgactaccncgggaacccnggtagtcgtcggtttggnttactttaacttaacttttcgtcgttacggttacggtaccgaacggaccggaccacggtccaccttaccgtaccccaaacttcttacgtttcttaagngtcgtgtactacgtacgtcccggtacccgtggtttcncgtacgtcgtaccttggtctcggtaccttaccgtacgtctcgtccctaaccgccgttacccgttaccacgaaccgtcgtacccgtccgggttcccaccgtaccncggttacggaccggtagtacggtcgtacttagttttaccggtatttacggttcttaaacgtgttaacccttaaccgtaagttaccgtaacggttacttacgggggtttacgggttcgggtacccgggggtaaacgggtccgggtaccgtaccggttaagtccccggtttaacggaccccgttaacgggacctaaccccggggtaacccggtttacccgggtcccgttaacccccgttccgtccccgggtttaaacctaccccccgtttccgttaaaccccccggttcccccgtaacccggttaccccg

SEQ ID NO: 274575 - DNA, 903 bp, Homo sapiens
  misc_feature: GYAE6OF01CISA1.27.23.C01.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccaggtctgccctgactcagcctgcctcgtgtctgggtctccgtggaccngtcgatcacctatcctcctgccacgtacgggaacccgngagtggtacggttggtcgtacttttaattaaccttttagttccgttagggtttaccgggtaacccggaacgtaaccgggacccgtacggaccgtaacccgttccggtaaccccctaaaaccttcgttaactttttaacgtttacttaggacttaggttactaacggttaaaccggttccccggggtaccccccggtttaaggggtttttccacggttaccgttccggttacctttacgttacggttacggtacccgttaacccgttaaggttcccgttacggtacccccgttaacccggtaaccccggtccccttaccccgtaccgtaaccgttcccgttcccggtacccgggtcccgttaccgtacgggacccgttacgggaacggcggggttacgtcgtttaaggttaaatttagtttacgttaggttaacttacgtaaacttaaccgttaaaccaacgttccggttaagtacccgttaagggttttcggggtaccgggttccgggggaacgggtaaccggggacgtaacgggttcgttccgggtaaacccggttcggtaaccgggtaccgaaaccgggtacccggtacggtccccgtaacccggtccccggttaccgggtaccttaccgttcccgtacccctttccccgtcccgtcccgg

SEQ ID NO: 274576 - DNA, 751 bp, Homo sapiens
  misc_feature: GYAE6OF01D8DUH.27.23.C01.1.454.CMB.1.raw
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcatcagggcacagggtcctgggccagtctcgccctgactcagcctgccttccgtgtctgggtctcgtggacagtcgatcacntctcctgctacgtcggaacccgnagtcgacgttggtgtcttaattaactttatcgttcggttgtaccgacgacggacccaggcctacgtcgtaccccaatcctagtttctttagtgtacgtgtacgtacgtaactccggtccccgttagggtttctagtactcgtcttacgtagtcggtcctaccgaagtccgtcgtacctacgtacccgtccctaccctacgacctacgttcccgtacccgggtctacccgagtacccgtaggaacgggacgttacggtatacgttaagtttatttagttacgtttaagttacctaagttaacttaaccgtaactaggttacgaaccgttacgggtttacggggttacgggttaccggggacggggtaaccgggtaccgtagggtacccgttcggtaacccggttaccgttaaggtacccggtaccggtaaccccgttaaagggccccgtcccggttaccccccggttcggttaccccgtaaccgtttccgttacccgggtttccccccgcccgttaccg

SEQ ID NO: 274577 - DNA, 768 bp, Homo sapiens
  misc_feature: GYAE6OF01EOLKG.27.23.C01.1.454.CMB.1.raw
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
tcagagcgtcgtctcacgaccggtgctcgatttagtacacgtgattagggagttgggggggggtctcaggaggcagcgctcgtcgggacgtctccaccatggcctgggctctgctacttcctcacccctcctcactcagggcacgacgggtcctcgggcccagtctcgccctagactcacgcctcgtcctccgttgtcgtcgggtctcgngacngtcactcaccatccttcncgaccacgtacggaacccgtgaatcggtggttggtattacttttaacttaactttcttcgttacggttaccggtaccgacgaaccggacccgagtaccttacctaccgtaacccctaattcgtttactttactttagtacgttagttcgtaacgtaacgtaccggtccccggtaccgggtttcggttctcgtacgtctacttcaggttcgacttcgacgtctcgacccgtacctccggtaccctccggtctaccgtacgtcccggtaccgtcctcggtaccgtcggtacgacggtacggtggtatacgttagtttacgtattcgttaacgtagttaactacgtaacgtacgtacgtacgttccggttaggttcgggtaaccgggttaccggggacggttaacggacccggtacggtgttaccccgggtaccggttggtacccgtacgggaccgtaaccccgggtcttccccgggcccttaccgggtccctaccgttcccgtttcccccgtaacccgtcccgttccccggtaaccgg

SEQ ID NO: 274578 - DNA, 766 bp, Homo sapiens
  misc_feature: GYAE6OF01EMI77.27.23.C01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatccaccatctcctgcacgtcggaacccgngatggtacgttggtcgtacttaataactttagtcgttggttcggtaaccgacgtacggacccgaggctacctcgtaccccaaatctatttctttagtcgattcgtacagtaacgtcccgggtacccgttagggtttctagacttcgtacgtttcctagtccggaccttacgaacgttccgtcgtacccgtacccgtaccggtccccttacccgtacgtaccctacgtttccccggtacccggtacccttcccgaacggtcccgtaaggggacggtaccggtacggtacgttaaggtttaacttttaggtttacggttaacgtttacgttactaacgttaacgtaaaccctaaacggttgtaacggttaccgttacgggtttggggtaccgggttaccgggacgggtacgggacgtaccggtcgtaccggtacccggttacgtacggtaccgaccggtacccgaagggtcccctcccggtaccccggttaccgttacctaccggtttcctcccggttccccctcgtacccgg

SEQ ID NO: 274579 - DNA, 754 bp, Homo sapiens
  misc_feature: GYAE6OF01EVO6Q.27.23.C01.1.454.CMB.1.raw
  modified_base (110)..(110): a, c, t, g, unknown or other
  misc_feature (110)..(110): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
  modified_base (393)..(393): a, c, t, g, unknown or other
  misc_feature (393)..(393): n is a, c, g, or t
  modified_base (500)..(500): a, c, t, g, unknown or other
  misc_feature (500)..(500): n is a, c, g, or t
tcagagcgtcgtctcacgaccggtgctcgatttagtacacgtgattagggagttggggggggtctcaggaggcagcgctctcgggacgtctccaccatggcctggctctnctattcctcaccctctcactcagggcacgtagggtcctcgggccctagtctcgccctgactcacgctgcctccggtgtcgtcggtctcgtagactgtacactcaccgatctcctnacgactcgggaacccngtatcggtacgttaggtacttactttaaacttacgtttctcgttaacggttaccggaaaccgcggtaaccgaaccgnggaccttaaccgtacccggtaacccttaaatccctttaagttttaactatggtacgtactaacgtacgggtaccncccgggtaccgtttggtatcttacgtccgtacttcgcgtacgtaccttcgaagtccacgtccgacggttcccccttaacgcgaaccgtttcggccccggttaaccgntaccgaccgttcggaaggcggtaacgtcggtattaagtaatttaacttagttgtaacttctaagttaccaaacgtaccgtagtaccgttaacggtcggttagggtacgggtacgtaaaccggggtcgtaaccggacggttccggaccggtaccggttaccgtaacggccgtaaccgtacccggaacggtccccggtacccgtccggttaacctaccgtacgttaccccgtccgtttccccgccgttaaacccgg

SEQ ID NO: 274580 - DNA, 724 bp, Homo sapiens
  misc_feature: GYAE6OF01EYR00.27.23.C01.1.454.CMB.1.raw
  modified_base (158)..(158): a, c, t, g, unknown or other
  misc_feature (158)..(158): n is a, c, g, or t
  modified_base (625)..(625): a, c, t, g, unknown or other
  misc_feature (625)..(625): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcaggcacgagggtcctgggcccagtcncgcccgtgacctcacgtcctcgtccgtcggttgtccgttcggtccttccgaggactgtcgactccacctctcctcgtgtaccacgtacggacccgcgtagtcggtacgttggattactttaacttaactttcttcgtcggttacgaaccgacgtaccgaccgagtcctacgtaccgtacccctaatccgttattcctttagcgtacgttagtacgtaacggttaccgtcccggtaccgttgggttcgtgtaccgtcgtcgttacgtacgtcggtacctaccgtacgtcctaccgtaccgtaccgtccgtccttacccgactaccggtacgtcccgtcccggtacacgttccgacggtcgaacggacggtacgtacttaggtactttagttagtacggttactacgtactaacctaacgaccgtgtacgtacgttcgggtcggttcgggacggtaccggcggtaccgngtccggtacgtaccggtaccgtcgaccggtaccgaccggtcgtccgtccccgccgttcccggtaccttacccgtaccttccccgtccctcccgtacccg

SEQ ID NO: 274581 - DNA, 768 bp, Homo sapiens
  misc_feature: GYAE6OF01BMCOM.27.23.C01.1.454.CMB.1.raw
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattggggggggtctcaggaggcagcgctctcgggacgtctccgaccatggcctgggctctgctattcctcaccctctcactcagggcacagggtcctgggcccagtcctgccctgactcagcctgcctccgtgtctgggtctcctggacagttcgatccactatctcctgcactggaaccctgatcgacgttggtnctttataactttntctgttcgtaccgagacggccaggcactcgtaccccaatcatttcttatgtatcgtactagtaacgtccggtacccctagggtttcctagtacttccgccgtttactacgtcggccttaccgtaacgtcctcgtaccctaccgaccggtccctcccgtacgtaacccgtcgttcccggtcccgggtacctaccgaaccggtcccgttaagggaccggaaccgggtaggtacccgtaggttaaccgttttaacgtttagtttacggttaacggtttacctaacgtttaaccgtaaaccgtaacgtaaccgttacggtacccgttaacgggtttccggggtaccgtttccggggacccggtagggtacccgacgggtccttaccggtacccgttccggtaacgggttacccgacccggtaacccgacgggttaccccgtacccggtaccccccgttagtacccgggttacccttacccgttcccgttaacccccgtacccgttaaccccgg

SEQ ID NO: 274582 - DNA, 879 bp, Homo sapiens
  misc_feature: GYAE6OF01C2EM8.27.23.C01.1.454.CMB.1.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
tcagagcgtcgtctcacgaccggtgctcgatttagtacacgtgattagggagttgggggggggtctcaggaggcagcgctctcgggacgtctccaccatggcctggctctgctattcctcaccctctcactcagggcacagggtcctgggcccagtctgcctgactcagcctgcctcgtgtctgggtctccgtgacagtcactcaccactcgtccncgcacgtccggaacccgngagtcgtacggttggtcgtactttattaacttttatcgttggttacggtaaccgaacgaaccggtacccacgggacctacgtaccgtaacccctaaaacttctacgttttactttagtacggttattacgtaactaacggtaccgttacccgggtcccccggtttaggggttttccgtaagtacgtttccggtcctttcgttaacgttccggtaccgttaaccgtaaacggttccgtaccggttaaccccgtaaacccggtccccggtccccctttaccccgtacgtaaccccgttacccgttcccggggtaccccgggtcgttaccccgtaaccgggttcccggtaacgggaacggggtaaacccgggtacggttaacgtttaacggtttaaactttttacgttaacgggtttttaagttaacgtttaaccgtaaattaacctttaacccggaaaccgttaggtacggttaaaccgggtttacgggtttcgggtaacgggttccgggaacggggttaccgaaccggtacggtcggtaaccggtccgtaccggttaacggtccgaaacgtcccgggtaacgtcccgttccccgacccggtttcgtacccggttcgtaccccggttttacgcccccgtccctaacg

SEQ ID NO: 274583 - DNA, 572 bp, Homo sapiens
  misc_feature: GYAE6OF01A450M.27.23.C01.1.454.CMB.1.raw
  modified_base (507)..(507): a, c, t, g, unknown or other
  misc_feature (507)..(507): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccctaggggtttctggactcgcttcagtgcctccaagtctcgccctacacggtaccctccctcgacccacgtctcccgggcctcccagccctcggaggaccggaggctagtattaagttattgttagtttcgattattacaaccgagttgacaacgttgggtaggttcgggcggtaggggaccncggcgtggtaccgtcacggtcacggccgacggctcgcccctcgtctctctcgtccctcccgtccc

SEQ ID NO: 274584 - DNA, 765 bp, Homo sapiens
  misc_feature: GYAE6OF01E5D9D.27.23.C01.1.454.CMB.1.raw
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
  modified_base (735)..(735): a, c, t, g, unknown or other
  misc_feature (735)..(735): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatccaccatctcctgcacgtcggaacccgngatcgacggtttggngtactttaataacttttntcgttgttcggtaccgacgacggacccaggcactcgtaccccaaactctacgtttctttatgtctagtacaaggttaccgtcccgggtacccccgttaagggggttttcctaggtacgttccggtaccttcgtacgttccggtactacccgtaagttccgtacgtaccctaccgtacccggtccccttcccgtacggtaacccctacggttcccgtccccgggtacctcccgtacggtccgttaccgggacgggaccggtacgggtacttagttaattttaattacgtttagttacgttactaataaccgtactaaccgagggttacgtaacgttacgggtttcggggttacggttcggggaccgggtacggggtacccgacgggtccgtaccggtacccggtaccgtaccggtaccgacccggtacccggaaccggtcccgtccccggtacccccgtcggttacccnccgttcgttccgttaccgtcccctaccccg

SEQ ID NO: 274585 - DNA, 772 bp, Homo sapiens
  misc_feature: GYAE6OF01AZ3CI.27.23.C01.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
tcagagcgtcgtctcacgaccggtgctcgatttagtacacgtgattagggagttgggggggggtctcaggaggcagcgctctcgggacgtctccacatggccgtgggctctgctattcctcaccctcctcactcgagggcacgacgggtcctcgggcccaggttcctcgccctgactcacgcctgtcctcgtgtcgtgggtctccgtgacngtcgatcaactntctccngacaccgtacggaacccgngtacgtggtacggttggtntactttaattaacgtttcgttcgttaggttacggtaccgacgaccggaccgacggactaccgttaccgtaaccctaacttctaactttttactttaatcgttagttactacgtaacgttaccggtaccccgggtaccccggtttagggtttccgtacgtacggttccgtttacgtttacgtcggtacggtacccttaacgttacgtaacgttccgtaaccctacccggtaaccggttccccgtaccgtaccgtaaccggttcccgttcccgggtacccggttccgtaaccgtacggtccgggtaacggggaacggtcggtaaggttaccttagttaactttagtttacttagttacgttactaacgttaccacgtaactgtaacgtcggttaggttcgggtaggtccggaacgggtacgacgtcggtacgtcgtaccgtacgacgtacgccgaccgtcggtcccgtcccgccgttacgtccttactccgtccctccctcgtaccg

SEQ ID NO: 274586 - DNA, 757 bp, Homo sapiens
  misc_feature: GYAE6OF01A6TSC.27.23.C01.1.454.CMB.1.raw
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
tcagagcgtcgtctcacgaccggtgctcgatttagtacacgtgattagggattggggggggtctcaggaggcagcgctctcgggactctccaccatggcctgggctctgctattcctcaccctctcactcaggcacagggtcctagggcccagtctgccctgactcagcctgcctacgtgtctggtctcgtggacngtcatcncactctctgctacgtcggaacctgtatggtacgttggtactaccttttaagtaaccttttagtcgttacggttcggtaaccgaccgaacggtaccctacggcctaccgttaccggtaaccccctaaatcctaactttactttacggtactacgttaccggtacttaacggtaaccgttccccggtaccccggtttaggggttactacggtaacttccggtacgtttctaacgtcggtacccttaacgtaaacgttcccgtacgtaccccgttacgtacccgttacccccgtacgtaccgtaccgaacgttcccgggacccgttccgtaccgtaacggtccggacgtaccgggaacgtcggtacttaacgttattacgtacgtttagtaccgttactaacgttaaccgtaccgtaacgtacgtacgtacttagggtaccggttgggtacggtacggcgagtccgtacgtcggaccgtcgttacgcgtaaacccgtgtaccgtccggtacccgcccgtacgtccgacgtttaccgccttaccggtcccgtaaaccg

SEQ ID NO: 274587 - DNA, 747 bp, Homo sapiens
  misc_feature: GYAE6OF01BOC8H.27.23.C01.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctgccctgactcagcctgcctcgtgtctgggtctctggacngtcgatcaccatctcctgccagtcggaaccccgngtattacggtacggtttggtacgtaccttttaaattaaccgttttattcgttcggttacgggtaacccggtacgaaccggtacccgacggacctaccgttaccgtacccccctaaacgttcctactttactttactagttatcgttactaacggttaaccggtacccggtacccccgggttaagggttttcgtagtacttccggtacctttacgtacggtcggtacccgtaccgtaacggttcctacgtacccgttaccgtacccggtcccttccgtacggaccctacgttcccgtccgggtccctacgacgtcgtaggacggacgacggtctagtatttattagttcgttatactatactaacctacgtagtacgtagtacggttacgggttacgttcgggacgggtacggacgtacggtccgtacggtaccgttacgtacggcgtccggtaccgacgggtcccgtcccgtccccgtacgtaccgtcttacccgtccttccccgtacctaccg

SEQ ID NO: 274588 - DNA, 730 bp, Homo sapiens
  misc_feature: GYAE6OF01BZLFR.27.23.C01.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
  modified_base (340)..(340): a, c, t, g, unknown or other
  misc_feature (340)..(340): n is a, c, g, or t
  modified_base (720)..(720): a, c, t, g, unknown or other
  misc_feature (720)..(720): n is a, c, g, or t
tcagagcgtcgtctcacgaccggtgctcgatttagtacacgtgattagggagttgggggggggtctcaggaggcagcgctctcgggacgtctccaccatggcctggctctgctattcctcaccctcctcactcagggcacagggtcctgggcccagtctgccctgactcagcctgcctcgtgtctgggtctctggcngtcgatcacatctcngcacgtcggaacccgngaatggacggttggtacgtactttaattaaacttttattcttggttacggtaaccgaacgtaacggacccagggcctacgtccgtaccccaaaacgtctactttacttttanagtacttcgtacgtaacggttaaccgtcccgggtccccgtaaggggttttcctagtacttcggtctttacgtaacgtcggtcctaccgtaagttccttaggccccttaacgaccggtccctccgttacggaccctacgttccgtacccgggtcctacgacggtaccgtaggacgggaacgtaggacttcggttaatttacgttagtttagttagttacaagttactaacaacgtaagtacgacgtaacggttgggttacggtacgggacggtaccgggaacgaggtccggtacgttaaccggtccgtaagggtccaaccggtacccgaaccggttcgacccgtccccggtacggtcccactttcccgtacgttccccccnccgttacccg

SEQ ID NO: 274589 - DNA, 763 bp, Homo sapiens
  misc_feature: GYAE6OF01CTZQG.27.23.C01.1.454.CMB.1.raw
  modified_base (236)..(236): a, c, t, g, unknown or other
  misc_feature (236)..(236): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
tcagagcgtcgtctcacgaccggtgctcgatttagtacacgtgattagggattgggggggggtctcaggaggcagcgctctcgggacgtctccaccatggcctggctctgctattcctcaccctcctcactcagggcacagggtcctgggcccagtctcgccctgactcagcctcgcctccgtgtcgtgggtctcctggacagtcgatcaccatcctcctgcacgtcggaacccgngatgtacggttggtcgtactttattaacgtttatcgttaggttacggtaaccgacgacggacccaggacctacgtaccgtaaccccaaactctatttactttatcgatcgtanaacgtaacgtccggtaccccgtagggtttcngtactcgtcttacgtagtcggtacctacgtaacgtcctcgtacctaccgaccggtcccctccgtacgaccctacgttcccggtccggtacctacccgaacggtcccgtagggaacgggtacggacggtcgtaagttactttaatttgttaggttacttaactataactaaccaaacgtagtacgtaacgttacggtttacggggtacgggttaccggggacgggtaacgggacccgtagggtacccgtaacgggtacccggtaccgtacgggtaccgacccggtaacccggaacgggttcccccttaccccgggtccccccggttacggttaacccgtacccgtttacccgtttcccccgttacccccgtccccgttacccgg

SEQ ID NO: 274590 - DNA, 989 bp, Homo sapiens
  misc_feature: GYAE6OF01ERC68.27.23.C01.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggagttggggggggtctcaggaggcagcgctctcgggacgtctccaccagtggcctggctctgctattcctccaccctctcactcgagggcacgacgggtcctcgggacccagtctcgcccgtgactcgacgccgtcgcctccgtgtccgtcggtctccgtggacnggtcgactaccacctatcctcctcgctacgacggacccgngacgtcggtacggttggacgttactttaacgttaactttacgtcgttacggttacggtaccggaacgtacggaacccgtacggacctaccgttaccgtaaccccctaacgttactttaccgttttactttacgtagttacggttacgtacgtaaccgttaaccgtccccgggtaccggtttacggggtttctacggacgttccgttacgttacgttacgtaccggtaccttaccgtaggttccgtaccgtacccgtaaccggtacccgttacccgtacccgttaacccgtaaccggttaccccgttaccgggtaccccgggttaccttacccggaaccgttccgggttaaccgggggaaccgtaacggggtacgttaacgttaacgtttaacgtttttaaacggttaggtttcccggtttaaacggtttaacttaaacgtttaacgtaaaccccgtttaaaccgggtacgtttaaacccgggttacgtttttaaccgggggttacggggtttaaccgggtttacccgggggacgggttaaaaccccgggggttcctaacggggttacccccggtttaaaccgttaaccccggggttacccgggttaaaacgtccccgggtaaaccccggtaacggttaaccccggtccccgttaaacccggttccccccgtacgggtaccctttaacccgtttcccgtttacccccccggttaaccgtccccccgttaaaccggg

SEQ ID NO: 274591 - DNA, 1085 bp, Homo sapiens
  misc_feature: GYAE6OF01ENCVH.27.23.C01.1.454.CMB.1.raw
tcagagcgtcgtctcacgaccggtgctcgatttagtacacgtgattagggagttggggggggtctcaggaggcagcgctcgtcgggacgtctccaccagtcggccgtggctctgcttacttccctccaccctcctcactcgagggcacgtacgggtccgtcggccctagttcctcgtacctcgacctcgacgtccctcgtcccgtccggttggtccggttcggggttcccttccggtaggaaccgtacggtaccgtaacttaccaaccgttaacttcccttccgtacgacccgtaacggtaacccggggaacccgtcgtagttaccggtacgggttttcggtaccgtttaacgttttaacttaaccgttttcggttccggtttacggttaaccgggaaccaacggaacccggacccgaggtacctaaccggttacccgtaaacccctaagtcctttaatttacgttagcgtaacgttcgtaacgttaacggtaacccggtcccccgggttaacggttttacgggttaccctagtacccgttttcgttaccgttacgtacgtacccggtaaccttaaacggttacgttacccgtaccggaccccgttaacccggttcccgaccccgtttaccccgtaagaacccccgtttaccggtcccgggttacccccggtacgttacccggtaccggttaaccggaaccgggtaaccgggtaacggtacggttacgtttaacggtttaaggttttaacgttttacggtttaccgtttaaacgttaaccgttaaacgttaaaccgttaaaccggtaaccgttaacgggtttaaccggttaaccggtttaccggggttaccggggtttacgggttaacccgggggtaaccggtaaccggggtaacccggtaaccgggtccgggtttaaaccgggtccccgttaaccgggtaacccggttaccccggtacccgggtaacccggttaccccggtaacccccggttaccccgggttacccccgtttaccccgggttaccccgttaacccgtttcccccgggttaacccccggtttcccccgtaaccccgttaccccgg

SEQ ID NO: 274592 - DNA, 849 bp, Homo sapiens
  misc_feature: GYAE6OF01DX5HE.27.23.C01.1.454.CMB.1.raw
  modified_base (205)..(205): a, c, t, g, unknown or other
  misc_feature (205)..(205): n is a, c, g, or t
tcagagcgtcgtctcacgaccggtgctcgatttagtacacgtgattagggagttggggggggtctcaggaggcagcgctcgtcgggacgtctccaccatcggccgtggctctgctattcctcaccctctcacgtcagggcacgacggtccgtcggcccagtctcgccctagactcacgcctcgccgtcgtgtcgtcggtcctcgnggactacgtcgactaccacctacttccgtacctacgacctaaccggtaccgggaaccccgtggtaacgttacggttacggtttcggttacgttaatttttaaactttaacttttacgttcggtttacgggttaaccggtaacccggaacggtaaccggtacccgacggtacctacccggttaccctaaacccctaattacccgtttaattttacgtttagtaggttaaccttacgttaaccgtaaccggttaacccggtcccccgggttacccggttttaagggtttcccaggttaccgttcgtttacccgtttagtaccggtcccgttaaccggttacctaacggttcccacccggtacccgtacccggcccgtttaccctaccggtacctaccgtccggtccggtcccggtacctcggaccgttcggaacggacggtagtcgtaacttaggttaaatttcgtttaagtaccgttactaactaacgtaaccgtaacgaacgttgtaacggttcgtcgggttacgggttacggaccggaaggtccggaacgtcggttaccgtacggaccgttgaccgtacggccgacgtaccgcccgtcccgtaccgtcgtacctttcccacccgtacccttccgaccgttacg

SEQ ID NO: 274593 - DNA, 864 bp, Homo sapiens
  misc_feature: GYAE6OF01CQ4NG.27.23.C01.1.454.CMB.1.raw
  modified_base (120)..(120): a, c, t, g, unknown or other
  misc_feature (120)..(120): n is a, c, g, or t
  modified_base (656)..(656): a, c, t, g, unknown or other
  misc_feature (656)..(656): n is a, c, g, or t
  modified_base (847)..(847): a, c, t, g, unknown or other
  misc_feature (847)..(847): n is a, c, g, or t
tcagagcgtcgtctcacgaccggtgctcgatttagtacacgtgattagggagttgggggggggtctcaggaggcagcgctctcgggacgtctccacatggcctgggctctgctattcccncacccctctacaactcgagggactacgacgggtcctgggccccaaggttcctacggcccctggaactcgacgccctcgaccgtccgttgtcgtcggggtacctccgtagggaccagttcgacttccaacctattcctacctggaccctaccggtaccggaacccccggtgtaacgttcgggtaacggttttggtacctaaacttttaatttaaaccgttttgtcgtttacgggttaccgggtaacccgaacgtaaccgggaccccgagggtaccttaccgtaccccgttaaaccccctaaagttcctttaattttaccgtttagacgtacgttaacgtacccgtaaaggttacccggttccccgggtacccgggttaagggttttcaacggtccgttcgtccgtttaagtcggtaccggttccttaacggtacttccgtaccggaccctaaccgggaccctcccgtaccgtactaccgtaccgttcccgggtacccgtcctaccgtaccgtggtaccgggaacgggcgttacggtnttacgtttaagttgtttacggtaagtttacgaactataaccgtacaaccgtaggtactacggtagtttcggggtacggtacgggcgggtaaacgcgtacgtccggtacgttacccgggcgttaacgcccggaaccgtaccgtaccggtccccacccgggttccctaggtcccctagtccccggtttacccncccccgtggtaaacccg

SEQ ID NO: 274594 - DNA, 803 bp, Homo sapiens
  misc_feature: GYAE6OF01D6GPZ.27.23.C01.1.454.CMB.1.raw
  modified_base (358)..(358): a, c, t, g, unknown or other
  misc_feature (358)..(358): n is a, c, g, or t
tcagagcgtcgtctcacgaccggtgctcgatttagtacacgtgattagggattgggggggggtctcaggaggcagcgctctcgggacgtctccaccatggcctgggctctgctattccctccaccctcctcactcagggcacgcgggtcctcgggcccagtctcgccctgactcagcctgcctcgtgtctgggtctctggactgtcgaatccaccactccgtcctggacaccgttacggaaccccgcgtaatcggaacggttggtcgtacttttaacgttaaccttttattcgttggttacggtaccgacgacggtacccaggcctaccgtacgtaccccaaacgtctatttctttancgtatcgtacagttacgtccggtccccggttaggtttctagtacttccgtctttactaacgtcgtaccttaccgtaacgttccgtacgtaccccgtaaaccgtcccggtccccgttacccgtaccgtaaacccgttcgttaccccgggttacccgggtccccttaccggaaccgttcccggttaagggacgggtaaccggaagttccgttaaaggtttaactttagtttaacggtttaggttaaactttaccaaatttaacccgtaaacgtaacccgttaaggtacgtaaccggttacgggttcggggtttacggtaccgggtaacgggaccggtacggtacggtccgtaacggtcccgttacgagtaccgtaccgtaccggacgttcccgacccggttaccccgtaccggttcctaaccgttccctaccttcccccgcctaccg

SEQ ID NO: 274595 - DNA, 700 bp, Homo sapiens
  misc_feature: GYAE6OF01EULDN.27.23.C01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcacactctcctgcacgtacggaacccgngaatgacgttggtcgactttaattactttatcgttaggttcggaccgacgaccggaccacggactactacgtaccccaaactctatttcttatgtatcgtactaagtaacggtcccggtcccgttagggttctgtcttcgtacttacgtacgtcgtcctacgtacgtctcgaccgtacgaccgtccctccgactacctacgtcccgtaccgggtcctaccgaccgtcgacgggacggtacggtaggtctagttaacgtttattacgtttacgtacttactaacttaactaacctaacgtacgtacgtacgtttacgggttcggttcgggtaccgggagggacgggtaccgaggtcccgttaacggtcccgttacggtaccgtaccggtaccgaccgggtaacggtcccgaccccgtccccgttacggtaccctccgttccgttccccgtccccgttccctaccgg

SEQ ID NO: 274596 - DNA, 648 bp, Homo sapiens
  misc_feature: GYAE6OF01CT79E.27.23.C01.1.454.CMB.1.raw
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (307)..(307): a, c, t, g, unknown or other
  misc_feature (307)..(307): n is a, c, g, or t
  modified_base (535)..(535): a, c, t, g, unknown or other
  misc_feature (535)..(535): n is a, c, g, or t
tcagagcgtcgtctcacgaccggtgctcgatttagtacacgtgattagggagttgggggggggtctcaggaggcagcgctctcgggacgtctccaccatggcctggctctgctattcctcaccctcctcactcagggcacgagggtcctgggcccagtctgccctgactcagcctcgcctcgtgtcgtcgggtcctcgtggacngtcgancacatctcctgctacgcggaaccgnatggtacgttggtcgtattagttaactttgtcgttgtacggtacacgacggccagctctaccgacctaactntatttctatgtatgtacacgtacgtcccggtaccgttaggttccagtcgtcgtacttgtacgtcggcctactagtccgacacccgtacgcccgtacccttcacgacccttgacccgtcggtccaccgtacgacgtggaccgaggtactcgtagttaattagttagttagtactcgaataaccgtacacgtaagtcgtaacgtttcgggtggtccgggttacgacgggnggaacgtcggacggtacgtacccgtaggtaccggtaccacgtacccgggactcccgtcccggtcccgttacggttcccttcccgttaccgtccccttccccgtcccgtaccgg

SEQ ID NO: 274597 - DNA, 891 bp, Homo sapiens
  misc_feature: GYAE6OF01B5PDR.27.23.C01.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (238)..(238): a, c, t, g, unknown or other
  misc_feature (238)..(238): n is a, c, g, or t
tcagagcgtcgtctcacgaccggtgctcgatttagtacacgtgattagggagttggggggggtctcgaggaggcagcgctctcgggacgtctccaccatggcctggctctgctattcctccaccctcctcactcgaggcacgagggtcctgggcccagtctcgcctgactcagctcgcctcgtgtctggtctcgtgacngtcatccaccattcncctgacctacgtacggaaccccgngtaacgtcggtacggtttggtcgtacttttaattaaacttttctcgttggtttacggtaaccgacgtaaccggaccagggtcctaacgtaccgtaaccccctaaacttcctaacgttttacttttagtagtacttacggtacgtaacgttaaccggtccccgggtaacccccgggtttagggttttaccaggttaccgttccgttcgttaactcgtaccgtaccgtacccgtaagttccgtaccgttacccgtacccggtacccgtcccccgttaccgtaccgtaacccgtcgttaccccgggttcccggtaccccttaccgaaccggtaccccgggttaaggaaccggggtaacccggtggttaaccgtttagttaaaccgtttttaagtttaacgttacggttttaaacgttcctaaactttaaccgaacccgtaacgttacgtaacgggttaccgtttaggggtttaccgggggttacgggttacccgggggtaacgggtacccgggtaaccggttaccgggtacggttaccggtaaccccggtttacgggtaccgtacccggacgtaaccccgggacgttccccggtccccgtaccccgtacggttccctacccgttcctttccccggtacccccttcccgtaacccgg

SEQ ID NO: 274598 - DNA, 859 bp, Homo sapiens
  misc_feature: GYAE6OF01ACXRR.27.23.C01.1.454.CMB.1.raw
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
tcagagcgtcgtctcacgaccggtgctcgatttagtacacgtgattagggattggggggggtctcaggaggtcagcgctcgtcgggacgtctccaccatgcctggctctgctattcctcaccctctcactcagggcacagggtcctggcccagtctgccctgactcagcctgcctccgtgtcgtgggtctcctggacagtcgatcaccatcctctgctacgtcggaacccgcgtatcggacgtttggngtactttataaacctttttntccgtttggttcggtaacccgacgaacggtaccccgaggcctaacgttccgtaacccccaaaattcctaattttccttttaagcgtacttgtacaacggttaacgtccccgggtaccccggttaggggttttccctagtacttaccggtccttttccgtaaggtccggtacctaaccgtaggttcccttacggaccccttacgaccggtccctcccgtacgacctacgtccggtaccggcctaccgacgtccgtacggacgggtaacgacgggttcttaaggttaacttttaacgttaggtttacggttaccgtttaactaaacgttacccgtaaaccgtaacggttacggtaacgttaaccgtttaacccggggtttgggtttacccggggtccggggtaacccggggtaacgggtaccccgtaggggttcccttaaccggggtaccccgttaccgttaacggggaacccctaccggggtaaccccctaacggggtccccctttaccccgggtaccccccgtttacgggttaccccttaacccggttacccgtttccccccgggtttacccccaaccccggtttaccccg

SEQ ID NO: 274599 - DNA, 767 bp, Homo sapiens
  misc_feature: GYAE6OF01CJTZ2.27.23.C01.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (545)..(545): a, c, t, g, unknown or other
  misc_feature (545)..(545): n is a, c, g, or t
  modified_base (621)..(621): a, c, t, g, unknown or other
  misc_feature (621)..(621): n is a, c, g, or t
  modified_base (709)..(709): a, c, t, g, unknown or other
  misc_feature (709)..(709): n is a, c, g, or t
tcagagcgtcgtctcacgaccggtgctcgatttagtacacgtgattagggattggggggggtctcaggaggcagcgctctcgggacgtctccaccatggcctggctctgctattcctcaccctcctcactcagggcacagggtcctgggcccagtctgccctgactcagcctgcctccgtgtcgtgggtctcctggacagtcgntcaccatctcctgccacgtcggaaccccgngtaatcggtacgtttggtcgtacctttaattaaaccttttatccgttggtttacggtaacccgaacgtacggaaccccgaggtacctaaccgtccgttaccccctaaaacttcctacgttttacctttttagagtattcggtactaacggttaaaccggttccccgggtaccccccggtttaagggggttttcctaggttaccgtcgttaccgttttcgttaacgttcggtacccttaaccgtaaacgttccgtcggtaccctaccgaccggtccccttcccgtacgtaccgtacctccggtccggtaccncccgtacgtccgtaggacgacggagtctagttaactttattacgttgttactactaataacctaacgactaaggtntacgttaggttcggttaggttcgggacggtacgggaccacgggtcgtaccggtccgttacggtacgtacgaccggacccgacgggtcncccccggttacccgacggttcccaacgttcccttaacccgttcccccgaccttacccg

SEQ ID NO: 274600 - DNA, 885 bp, Homo sapiens
  misc_feature: GYAE6OF01E206I.27.23.C01.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctggcccagtctgccctgactcagcctgccctcgtgtcgtggtcctccgtggacngtcgatccacctatcctccgtgcacgtcggaaccccgngatcggtacggttggctactttaattaacttttatcgttggttacggtaaccgacgaacggaccaggccacgtccgtaccccaaattctatttctttagtgtatgtactaacgtaacgtcccgggtaccccggttagggtttacctggtactccggtacctttacgtacgttccggtacccttaacgtacggttcctaccggtaacccgttaccggaacccggttcccccgttaccccgtagtaaccctacggttccccggtcccgggtaccctaccgacccggtaccgtacggggtaaccgggtacgggtacggttaacgttagtttaaacttttacggttttaactttacgggtttaactttaacccaaacgtttaacctaaacccgttaaccggtaagttaccggtaaccgtttaacggggtttacgggttaccgggggttacccggggtaacgggggaaccgggtaacccgggtaagggttcccgttacggggttaccccgggttacccgtaaacgggtcccggtaacccggtaccccgggaaaccgggtttccccgtaccccggtccccccggttaaccgggttccccttaacccggtttaccccggtccccggtttacccccgtcccccgttaacccgg

SEQ ID NO: 274601 - DNA, 845 bp, Homo sapiens
  misc_feature: GYAE6OF01BGPUG.27.23.C01.1.454.CMB.1.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (552)..(552): a, c, t, g, unknown or other
  misc_feature (552)..(552): n is a, c, g, or t
  modified_base (829)..(829): a, c, t, g, unknown or other
  misc_feature (829)..(829): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcgagggcacgacgggtcctcgggcccagtctcgccctgactcacgcctgccttcggtcgtcgttcgggtctccggtggacagtcgatccaacctntctaccgtcgactacgacgacccgngacgtcgtacggttgtacttactttaacttacttacgttcgttacggttcggaacccgtacgaccggacccggacgtctaccgttaccccgtaaccctaacttacgttactttacgtttacgttaagtcgttacgttaccgtaaagttaccccgggtccggtacccccggtttaggtttccgtacgttaccgttcgtaccttttacgtaccggttacgtccttaaccggttacgtccggtaccgtaacccgtcccgggcctccccgttaccgacctaccgtcgttacccgccggttacccncgaaccgtccggtaccggacggtacggtacgtacggttacgtttaagttacgtttacgtacgttttaactaattacgtaaacctaccgtacggtacgttcgtaacggttggtacgggttcgggtacgggtaccggacggtacggtaacgtccggtaaccggttacccgaccgggttaccgacccggtaaccggtcccggttaccccggccccggtttaaccccgggttccccgtaccggttaccccttccttacccccggggttcccccgtttaccncccggtttaccccggg

SEQ ID NO: 274602 - DNA, 799 bp, Homo sapiens
  misc_feature: GYAE6OF01BA5A5.27.23.C01.1.454.CMB.1.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctcgccctgactcagcctgcctcgtgtctggtctctgacagtcgatcaccntctctgcactcggaacccngatggtacgttggtgtcttaataactttctcgttgttacggtaccgtacgaccggtacccgaggctacgtcgtaccccaaactctaactttctttatgtactgtactagtaacgtccgggaccccgttagggtttctacggacttaccgtcttacgtagtcggtcctaccgtaacgttcctacggtaccctacggtacccggtccccttacccgtacgtacctacgtcccggtaccgggaccttcccggacgtccgtacgggacgggtacggtacggtcttaaggttaatttacgtttagttacggttactttacgattactaaaccgtaaccgtaaggttacgtaacgttaccgggtttaggggttacggtttaccggggaccggggttacgggtacccggtaacggttcccggtacccggttacccggttaccgggtaaccggtacccgtaacgggtacccccgttaaacgggccccgtttacccccgggaacccccctttaccggggtacccttaccccgggttccccgtttaccccggtttcccccggttaacccccgtttaaccccgg

SEQ ID NO: 274603 - DNA, 723 bp, Homo sapiens
  misc_feature: GYAE6OF01DDBDG.27.23.C01.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
tcagagcgtcgtctcacgaccggtgctcgatttagtacacgtgattagggattggggggggtctcaggaggcagcgctctcgggacgtctccaccatggcctgggctctgctattccctcaccctcctcactcagggcacagggtcctgggcccagtctgccctgactcagcctgcctccgtgtctgggtcctcctggacngtcgatcaccatctcctgccacgtcggaacccncgatgtacggttggtgtacttaattaactttntcttggttacggtaccgacacggacccgaggcctacnccgtaccccaaactctatttctttatgatgtctaagtaacgtccggccccgttagggttttcngtactcgtcttctatcggacctaccgtaagtcctcgtaccctaccgtaccgtcccctcctagacctacgtccgtccggtctacccgtaggcctgggaacggacgacggtcttaagtaatttagtttagttcgttaacgttaccaattaaccgttaaccgaaccgtaaggttcgtaaccgtacgggttttcggggttacgggttaccggggacggggaacggacccgtagggtcccttaaccgggtcccgtaccgtacgggtcccgaacccggacccggtaacgggtccctacccgggttaccccccgttacggttcccacccgtttcccttaccccggtcccccctacccgtaaccc

SEQ ID NO: 274604 - DNA, 973 bp, Homo sapiens
  misc_feature: GYAE6OF01C00IJ.27.23.C01.1.454.CMB.1.raw
tcagagcgtcgtctcacgaccggtgctcgatttagtacacgtgattagggagttggggggggtctcaggaggcagcgctctcgggacgtctccaccatggcctggctctgctattcctcaccctcctcactcagggcacgaggggtcctgggcccagtctcgccctgactcagcctcgcctcgtgtcgtcgggtctccgtggacgagtcgatccacctatctcctgcgtaccgcggaacccgcgtagtcggacggtttggtacgtactttaacttaactttactcggtttggtacggtaacccggacaaccgggtacccgacgggtacctaaccggttacccgtaaacccccgtaaatttccttaaacgtttttccgttaacgttaggaacttttcgaacgttaaaaccggttaaccggtttccccgggttacccccggttagggggtttttctacgggtaacccttcggttacctttacgtaacggtttccggaccccgttaaccgtaaacggttccgtacccgtaccgtacccgttaccccggtaccccttaccccggtcgtaaaccccgttcggttccccgggttacccgggtccgtaacccgtacccggtccccggttaaggaaccggggtacccggtagggtttaccgtaacgggtttttaaaccttttaagggtttttccggttaccggtttaaaacggttttaacccaaaccgtttttaaccgaaaaccccgtaacgggttaacttacgggttaaccgtttaaccggggttttgggtacccggggtttacggggacgggtaaacgggtcccggttcgggtaccttaacccggttaaccgggtcccggtttagaacccgtcccggtaaccggacccggtcccggttacccccggtccccggtttaacccggtccttaccccgggttaccccgtttcccccggaaccccgttcccccgttaacccggg

SEQ ID NO: 274605 - DNA, 750 bp, Homo sapiens
  misc_feature: GYAE6OF01BFQBN.27.23.C01.1.454.CMB.1.raw
  modified_base (244)..(244): a, c, t, g, unknown or other
  misc_feature (244)..(244): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacgagggtcctgggcccagtctcgccctgacctcagcctcgcctccgtgtcgtggtcctcctggacagtcgatcacctatccgtcctgcctacgtaccggaacccgngtacgtcggtacggtttggtactacgttttaaagttaaaccttttagttccgtttagggtttaccggtaacccgtaccgaacgggaccccgtaggaccgtaaccgttaccggttaaccccctaaaacttcctttaacgttttccttttaacgtacggttaattaccggtacgtaacgttaaccggttccccgggtaccccgggtttaaggggttttcacgtacgttccgtacgttcgtacgtcggtacctacgaagttccacgtaccgtacgccgtccctacggtaccaccgtcgtccgccggtacctccgacgtccgagggaacgacggtacgtcttaagttaatttattagtgttactactaataccaacgactaggtctaacgttcgggtggtaggtccggacggtaggacacggtcgtcgttaccgtcggtacgtaccgacggtcccgacgtcccgtccgcccgttggtaccctccgttcccgttcgtccccgtacctccgg

SEQ ID NO: 274606 - DNA, 688 bp, Homo sapiens
  misc_feature: GYAE6OF01EUE3C.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaaccccgngatgacgttggtcgactttataacttttatcttgttcggtaccgacgacggacccaggcactcgtaccccaatcctatttctttatgtatcgtactaacgtaacgtcccggtccccgtagggtttctggtacttccgtctttcctagttcggccttaccgtaagttcctcgtaccctaccgacccggtccctaccccgtacgtaccctacgtccgtcccggcctaccgacgtccgtaggacggacgacggtctagtatttattagttcgttacgttactattaactaactaaccgtgtacgtacgtacgttcgggtcgggttcgggacgggtacgggaccgtacgggtccgtacggtacccgttaccgtaacggtaccgaccggacccgtacggtcctacccggtccccgttaccggtcctaccgtcccgttcccggttccccgtcccgtaccg

SEQ ID NO: 274607 - DNA, 819 bp, Homo sapiens
  misc_feature: GYAE6OF01E4YOO.27.23.C01.1.454.CMB.1.raw
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
tcagagcgtcgtctcacgaccggtgctcgatttagtacacgtgattagggagttggggggggtctcaggaggcagcgctctcgggacgtctccaccatggcctggctctgctattcctcaccctcctcactcagggcacgagggtcctgggcccagtctcgccctgactcagcctgcctccgtgtctgggtctccgtggactagtcgactcacctatcctccgtgccacgtcggaaccccgngtactggtacggtttggtcgtactttaattaaaccttttntccgttcggttacggtaaccccgtacgaaccgggtaaccccgaggacctaccttaccggttaacccccctaaaacgttccttaacttttaccttttaacgtgtaacgtttcggtaccgtaaacggtttaaacccggtccccgggtacccccccggtttaagggggtttttccctaggtaaccgttccgttaccgtttaccgtaagttccgggtacctaccgtaaacgttccgtacgtaccccgtaaccgacccggttccccgttcccctacgaaccctacccgtcccggtacccgggaccgttacccgaccggtcccggtaggggtaaccgggacggtacggttacgttaggttaacttttagttacgtttagggttactttacaaacgttactaacccgtaacgtagtacctacgtacggttcgggtcggttacgggacggacggtacacggtctccggtaccctcggaccgacgaccgtccgacggtcctcccgcccgttcgtcctaccgtccgttccccgttcccgcccgtccg

SEQ ID NO: 274608 - DNA, 760 bp, Homo sapiens
  misc_feature: GYAE6OF01DW84U.27.23.C01.1.454.CMB.1.raw
  modified_base (251)..(251): a, c, t, g, unknown or other
  misc_feature (251)..(251): n is a, c, g, or t
  modified_base (285)..(285): a, c, t, g, unknown or other
  misc_feature (285)..(285): n is a, c, g, or t
  modified_base (426)..(426): a, c, t, g, unknown or other
  misc_feature (426)..(426): n is a, c, g, or t
tcagagcgtcgtctcacgaccggtgctcgatttagtacacgtgattagggattggggggggtctcaggaggcagcgctctcgggacgtctccaccatggcctgggctcgtgcttattcctccaccctcctcactcgagggccaacgagggtcctgggcccagtcctgccctagacctcacgcctgacctccgtgtctcgggtcctcgtggaccagtcgactccaccatcctcctgccacgtacggacccgngattacgacggttgtcgtactttaattaactttntcgttggtacggtaaccgacgacggaccctaggacctaccttccgtaaccccaaacttctttaacttttcgtttaactacggtacttacggtacctaaacggttacggtacccccgggtaccccgtttaggggttttaccncggtactaccggttcttactacgtcgtacctacgtactccgaccgtacctaccgcccgtcctaccacgtactacgtacccggtccggcctaccgacgtccggtaaggacggtaacgcgtctaacgttaatttacgtttacgttaggttaccttacgtaaattacccaaacgtactacgggttacgaacgtttacgggttaggtccgggttacggggaaccgggtacggaaccttgggaccgtaccggtcccgtacgtacggtaccgacgtacccggacgtcccgtaacccggtcccgtacgtccgtaccttaccgtcccctacccgcctacccg

SEQ ID NO: 274609 - DNA, 707 bp, Homo sapiens
  misc_feature: GYAE6OF01DI9UE.27.23.C01.1.454.CMB.1.raw
  modified_base (199)..(199): a, c, t, g, unknown or other
  misc_feature (199)..(199): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacagggtcctgggcccagtctgtcctgactcagcctgcctccgtgtctgggtctcctggacngtcgatcaccatctcctgccacgtcggaacccgcgagtgtacgttgggtgactttattaactttatcttggttcgtaccgacgacggaccagcactcgtacccaactctatttctttatgattgtcgaagtacgtccggtccccgtagggtttctgtactcgtctttctagtcggtactaccgaagtcgtcgtacctactacccggtccctccctacgaccctacgttcccggtcccggtcctccgacgtccgtaggacggtacgacggtcgttacgttaacgtttaacgtttatttacggtttaacgttactaacgttaaccttaacctaaaccgtagttacgtaaccgttacggttcgggtttacgggttaccgggacgggtaacgggtaccgacgggtaccgtaccgtaccgttacccggtaggtaccgaccggacccgacggtcccgtacccgtcccccgtacgttccgtaaccctccgtttacccgccccgtcccgtaccccg

SEQ ID NO: 274610 - DNA, 856 bp, Homo sapiens
  misc_feature: GYAE6OF01AP0XV.27.23.C01.1.454.CMB.1.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctcgggccccagtcctcgcccctaggacctcacgcctcgtccctccggttgtcttcgggtcctccgtagactacgtcgatccacntctccngcacgtcgaccgngatcgtcgttgctacttattacttctcttgtacggtacacgcgacngctcctacgacccaatctacttacttgtagngttacgtctaacgttacccgtcccgggtacccggttagggtttctaacggtcttcgttaccgttacgttcgtacgtccccgttactacgttccgttacgcccgtaaccggtcccgtcccccttaccgccgttaaaccccgtccggttccccggtaccccggtaccgacccggttaaccggtcccggtaacggggttaacccgggaaccgggttcggtacgttttaaccggtttaaattttccgggtttaagttttaccgttttacgttaaaccgtacgtttaaacccacccggttaaacggttacgttaaacggttcggttttaaccgggtttacgggtcgggggttaacccgggaacgggtaccggggtaagcccggttaaccgggtttccggtacccggttacccggtaagacccggtacccccggtaccggttaaccccgggtcccccgttaccgtaccccccggttacgggttcccctttacggtaccccccgttcccgttccccccggttcctacccccgggg

SEQ ID NO: 274611 - DNA, 694 bp, Homo sapiens
  misc_feature: GYAE6OF01CE4RP.27.23.C01.1.454.CMB.1.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
tcagagcgtcgtctcacgaccggtgctcgatttagtacacgtgattagggagttggggggggtctcaggaggcagcgctctcgggacgtctccacatggcctgggctctgctattcctcaccctctcactcagggcacgaggtcctgggcccagtctgccctgactcagtcctgcctcgtgtctgggtactcctggacaggtcgatcaccatcncctgcacgnggaccnagtgacgttggctacttataacttntcgtggttacgaccganacggacctagcactcgtacccaatntacttcttacngtacgtacgttcacgttaactccggaccccgttagggtttaccngtaacgttcgtaccttactaggtacggtccttacgtaagtccgttcgtaccccgaacgtacccgaccttacccgtacgtacgtaccgtccgtacccgggctcgactccgagaccggaggacgtactggttaacttacgttacttaggtattaccgtaaatactaaccgaaacttacggtaagtaacccgtacggtttcgggtacgtttaccgggacgggtaacgggaccgtacggtacgtccggtaacccgtaccggttacggacgtacccggtacaacggtacctcccggtaccccgttcggtaccctacgtcccgtttacccgtcccgtccccgtaacccg

SEQ ID NO: 274612 - DNA, 791 bp, Homo sapiens
  misc_feature: GYAE6OF01AWV7K.27.23.C01.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
tcagagcgtcgtctcacgaccggtgctcgatttagtacacgtgattagggagttgggggggggtctcaggaggcagcgctcgtcgggacgtctccaccatggcctgggctctgctattcctcaccctctcactcagggcacgagggtcctgggcccagtctgccctgactcagcctgccctcgtgtctgggtctcctggaccagtcatcaccatctctgcactggaacccngatggacgttggtntacttataactttntcgtggttcgaccgacgacggaccgagactactcctaaccctaactcttatttcgtttangtatntacgtaacgtaccgtcccggtacccggttaggttctagtacgttcgtaccttacgtagtcgtacctaccgtacgtcctaaccgaccgttaacccggcccgttaccctcccgtaacgtaccctaccggttcccggtacccgggtaccctaccgtccgtaccggtaacgggaaccgggtaacggttacgtacgtttaacgttaacgttttaagtttacgtttacgttaagttaaccgttaaactaaccgttaaacctaacgtaacgtttacgtaaccggtttacggggtttaggggttccgggtaaccggggaccgggtaacgggaccggtacggtaccggtaacccggttacccggttacggtaccgggtacccggaaaccggtacccggacgggtcccctacccccggttcccgtacccggttacccttacccgtttccccgtcccgttccccgtaccccgtaccgg

SEQ ID NO: 274613 - DNA, 751 bp, Homo sapiens
  misc_feature: GYAE6OF01EBDUV.27.23.C01.1.454.CMB.1.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (563)..(563): a, c, t, g, unknown or other
  misc_feature (563)..(563): n is a, c, g, or t
tcagagcgtcgtctcacgaccggtgctcgatttagtacacgtgattagggagttggggggggtctcaggaggcagcgcctctcgggacgtctccaccatggcctgggctctgctattcctcaccctcctcactcagggcacgagggtcctgggcccaggtctcgccctgacctcacgcctcgcctccgtgtcgtcgggtcctctaggacagtcgatccaccatcctcgngccacgtcggaacccgngtagtcggtacgttggtcgtaactttaattaacctttattcgttcggttaccggtaaccgacgaccggaacccgtaggacctaaccgtaccgtaaaccccctaaacttccgttaacttttaccgtttaagtcgttaacgttagtaccgtaacggttaaccggttcccgggtaccccggtttagggtttcagttacgttccggtcttccgtagtcggtccttaccgtagtccgtcgacccgtcctaccggtaccctcccgacgtacctaccgttccgacccggcctcgacgtccgaggacggtacgagtcgtaagttntttagttagttcgttaagttactaagttaacaacctacgtagtcgtaagttcggttacggtcgggtacgggcggacggtacgcgggtctaccggtccgtcggtaggtcccgaaccgtaccgtccggtcccgtccccgtaccccgtttcgccctttaaccgtcccgtttccccgcccgtccctaaccgg

SEQ ID NO: 274614 - DNA, 750 bp, Homo sapiens
  misc_feature: GYAE6OF01AZ1GB.27.23.C01.1.454.CMB.1.raw
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
tcagagcgtcgtctcacgaccggtgctcgatttagtacacgtgattagggagttggggggggtctcaggaggcagcgctctcgggacgtctccaccatggcctgggctctgctattcctccaccctctcactcgagggcacgacgggtcctgggcccagtctcgccctgactcagcctgcctcgtntcgtggctcgngacagtcatcacatctcngctacgtcggacccngagtcgtagtgtctcttaatacttntcgtggttacggaccgacgtacggaccagacctacctacgtacccctaaactnttactttacgtttagtgttacgtacgtacgtacggtaaaccgtcccggtaccccggttagggtttactagttactcgttcttacgtaggtccgtaccgtaccgttaactcgtccgtaaccgtaccgtacccggtccctaccgtacgtacctcgtacccgtcccgggtactcgtaacggcgtaggaaccggtaggtacgtacttaacgttaatttaagtttacgtagttacgttaatagtaaacctacgaccgttagtacgtaccgttaggttacgggtcggttaccgggtaacgggaaccgggtacgtacggcccggttaccggtacccggttacgtaacggttacccggaacgggtaccccgtacggttaaccccggcccggtaccccgttaccggtaccctttaccggtaccccttaccttaccccccgtcttacccggg

SEQ ID NO: 274615 - DNA, 924 bp, Homo sapiens
  misc_feature: GYAE6OF01AFU5R.27.23.C01.1.454.CMB.1.raw
  modified_base (316)..(316): a, c, t, g, unknown or other
  misc_feature (316)..(316): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcaggcacgagggtcctgggcccagtctcgccctgactcagcctgcctcgtgtctgggtctccgtgacagtcgactccacactcctcctgcctaccgtacggaaccccgcgtagtcggtacggtttgggtcgtactttaattaacgttttagtcgttggttacggtaaccgacgaacggacccgnggacctactaccgtacccctaaaacttcgtaacttttccgtttaagtacgtacgttcgttaactaacgggtttaacccggtccccggggttacccccggtttaagggggttttaccgtacgttacggtttcccggttaaccgttttaccggtttaaccggttccggttaacccttaaccgttaaccggttcccgttaccgtaccccggttaccgtaacccggttccccttacccgttaccgtaaaccccgtcgttcccccgggttacccggacctcccggaaccgtccggtagggaaccgggaccgggtagtcgtttaagttaacttttaacggtttacgttttacggttaacgttacgtaaacgttaaccgttaaaacccgtacgttaaccggttaacgtccggtttaacgggtttcggggttacgggttaccggggaccgggtaacgggccgtacgggtcctaaccgggtccgtaccggtaaccggtcccgtaaccgggtaccccggaacggtcccccgtaccccccgggtaacccccggtttcggtaaccccgttaccccgttccccgggttacccccggtttaccccccgcccgttaaccccgg

SEQ ID NO: 274616 - DNA, 787 bp, Homo sapiens
  misc_feature: GYAE6OF01BG4TX.27.23.C01.1.454.CMB.1.raw
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
  modified_base (374)..(374): a, c, t, g, unknown or other
  misc_feature (374)..(374): n is a, c, g, or t
  modified_base (506)..(506): a, c, t, g, unknown or other
  misc_feature (506)..(506): n is a, c, g, or t
tcagagcgtcgtctcacgaccggtgctcgatttagtacacgtgattagggagttgggggggggtctcagggaggcagcgctcgtcgggacgtctccaccatggcctgggctctgctattcctcaccctcctcactcagggcacgaggtcctgggcccagtctcgccctgacctcacgcctcgcctccgtgtcgtggtcctccgtggacagtcgatccaacctntccgtcctgacctacgtacgggaacccgngtagtcggtacggtttggtgttacctttaattaacttttgtcgttcggtttaccggaaccgaacgaaccggacccgacggtccaccgtacctaaccccctaattcttacttttagtatagtntacgtacgtaacgtaccgcccggtccggttagggtctgtactcgtacttcgtcgtactcgtaaccgtacgtctacgtcccgtacgtccgtccctccgacctccgtactcccgggtccgtactccgcgtcggngaacggtagacgtacgttagtactttaacgttgttacgttagttactaactaacgtaaccgtagttacgcgtttaacgtacgggttcggttaccgggttacgggtaccgggaacgggtaaccgcgggttaacccgtcggttaaccgtaccgggttaccgaacccggtaaccgggtacccccggtaagggttccccccgttaccccggtacccccggttacggtaccccccgttcccgttttacccccgggtacccctccccccggttaaccgtacccccgg

SEQ ID NO: 274617 - DNA, 696 bp, Homo sapiens
  misc_feature: GYAE6OF01CIK7G.27.23.C01.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
tcagagcgtcgtctcacgaccggtgctcgatttagtacacgtgattagggagttggggggggtctcaggaggcagcgctctcgggactctccaccatggcctgggctctgctattcctcaccctcctcactcagggcacagggtcctgggcccagtctgcctgactcagcctgcctcgtgtctgggtctccgtggacngtcgatcacctntcctcngccacgtcggaacccgngatggacgtttggcactttagttaactttatcttggttacggtaaccgacgtacggacccaggccacgttcgaccccaacttcatttcttatgtatcgtacagtacgtccggcccgttagggtttcagtctcgtcttactagtcggtacctacgtaacgtctacgtccgtacgtaccggtccctccgtacgtacctacgtccgtacccggcttaccgacgtccgtacggacggacgtacggtacgttagtaagtttacgttacgttagttacgttactattaacgtaacgactagttacgtacttacgggtttcgggtacggtttcgggacgggtacgggtaccgtcggtacgtcgtaccggttcggtacggttaccgaccggtaacccgtacggtcccgtacccggttcccccgttacggttacctaccgttacccggttccctccccggttccctacccgg

SEQ ID NO: 274618 - DNA, 781 bp, Homo sapiens
  misc_feature: GYAE6OF01AJXN7.27.23.C01.1.454.CMB.1.raw
  modified_base (416)..(416): a, c, t, g, unknown or other
  misc_feature (416)..(416): n is a, c, g, or t
  modified_base (681)..(681): a, c, t, g, unknown or other
  misc_feature (681)..(681): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctcgtgtcgtggtctcgtggacagtcgactccactactcctccgtagcctaccgtcgggaaccccgcgtagtcggtaacgggtttgggtactaccttttaaattaaccttttattccgttggttaccgggttaacccgacgtacggaccccgacgggtacctaccgttaccgtaacccccgtaaacttcctacttttaccttttagttacggtaattcggtaaccgtaacggtttaaccnccccggggtacccccggttaggggttttccacgtaacgttccgttcctttacgttacggtcggtcctaacctaacggttctacggttaccctacccggtaccggtcccctacccgtccgtacctacgttcccggtcccggtcctccggtaacgcgttacgggaacggtcgtaacgtcgttagtacttttagtacgttgttacttactagtaactaacacgtagtacgaccgttaggttcgggtacggtcgggacgtacgggacgnggtaccctcggaaccgttacgtcggtaccgccgtacgaccggtcccgttccgaccccggtcgtacctaccggttccgtaccccgtcccgtacccgtaccg

SEQ ID NO: 274619 - DNA, 768 bp, Homo sapiens
  misc_feature: GYAE6OF01DZUNS.27.23.C01.1.454.CMB.1.raw
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (728)..(728): a, c, t, g, unknown or other
  misc_feature (728)..(728): n is a, c, g, or t
tcagagcgtcgtctcacgaccggtgctcgatttagtacacgtgattagggattggggggggtctcaggaggcagcgctctcgggactctccaccatggcctgggctctgctattcctcaccctcctcactcagggcacagggtcctgggcccagtctgccctgactcagcctgcctcggtntcctggtctctggacngtcgatcacagttctctgcactggaacccgcgatcgacgttggtanacttattaaccgtttntccgtgtttaggaaccgtacgacggtacccaggcctaacttcggtccccctaaaacgtctaacgtttctttatgtaaccttgtactacgtaaattccccggccccgtaaggggttttccgtagacgtttccgaacttttccgtattacgggttaccctacgtaaccggtcttcgggacccttacctaccggggtcccttaccccgttcggtaacccctacttcggtccccgggtaaccgttcccgaacgtacccgttcggacggtacgggtaaacgtccgtaggtttacttagtttactaggtttaacgtctaacttactaacgaacctgtaggtaacgtaccgtttagggtcggtaccgggtcgggaccggtaaccgtaggccgttacgggaaccttcccgtaaacgggtccctaaccggaccccgaaaggttccccgttaccggtaccccccgtaccgggtttaccncccggttaaaccccttcgggtaccccctcccgttaacccg

SEQ ID NO: 274620 - DNA, 890 bp, Homo sapiens
  misc_feature: GYAE6OF01B48PC.27.23.C01.1.454.CMB.1.raw
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
  modified_base (276)..(276): a, c, t, g, unknown or other
  misc_feature (276)..(276): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcacgcctgcctccgtgtctgggtctccgtggacagtcatcaccntctccgtgccacgtcggaacccgngaactggtacggttggtagtactttaattaaaccgttttnttcgttaggtttacggtaacccggtaacgaaccgggaacccgaggacctaccgttaccgtaacccctaaacgttctacttttactttagtcgtagttacggtactaacggttaaccgtcccgggtacccccggttaggggttttacctagtaccgttccgttacctttacgtacggttcggtaccttaccgtaacgttcctaccggtaccccgtaaccggccccggttacccctcccgtaccgtaaccccgttacgttccccgggttacccgggtacccttacccgaccggttacccggttaacgggaacgggttaaccgggtacggttaacgttaaggtttaacgttttaacgttttacgtttaacggtttaacggttaacttaacgtttaaaccgtaaccgtaaacccggtaaggttacggttaaccgttacggggtttcggggtaccgggttaccggggtaacgggtacccggggtaactaccgggtaccgtaccgggtacccgttaccggttacgggtaccacccggtacccggacggttcccctccccgggtacccccttccggtaccttcccgttcccgtttacccccgttccccgtccccgtaaccg

SEQ ID NO: 274621 - DNA, 719 bp, Homo sapiens
  misc_feature: GYAE6OF01BNU0M.27.23.C01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcctggacagtcgatccaccatctcctgcacgtcggaacccgngatcggtacgttggtcgtactttaattaacttttatcgttggttacggtaccgacgacggacccgaggcctactccgtacccctaaactcctactttctttagtgtatcgtacgtacgtaaccgtcccggtaccccggttaggggtttctcggtacttccgtcttacgtacgtcgtacctaccgtaagtctacgtaccctacgacccggtccctacccgtacgacctacgtccgtccgggtcctaccgacgtccgtaggacggacggtacggtctagttaatttaacttacgttgttaacgttactaacttacgtaacaacgtagtactacgttacggttggggtacgtccgggacggtacgggtaccgagggtcctacggtacccgttaccgtacggtccgaccgacccggtaacggtcccgtacccggtccccgttacgtccgtacccgttcgttccccggtcccccgtcccgtacccgg

SEQ ID NO: 274622 - DNA, 809 bp, Homo sapiens
  misc_feature: GYAE6OF01BMGLC.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcatcaccatctcctgcacgtcggaacccncgatgacgttggtgtactttaataactttattcgttaggtttacggtaaccgacgaacggtacccagggacctaccgttccgtaacccccaaatacccttattttacctttagttacgtagttcgttacctaacggttaaccgtcccgggtaccccccgttaggggttttcctacggtactccgtaccgttttacgttacgttcggtacctaccgtaacgttcctacggtacccctaacggtcccggtcccttcccgtacgtaaccctacgttcccgtacccgggtcctcccgaagtcccgttaggggaaccgggtacggtacggtccgtttaggtaactttttacgttaacgttttacggttagtttaccgtaattaaccgtaaacccgtaactacgggttaacgtaaccgtttacggttgggggttccgtttccgggggaacgggtacgggacgtacggggtcctcgggtaaccccgttcgggttaacgaccgaccgtacccggacgggttccgttccccggcccccgttaggtaccccttacgttccgttacccccggttccccaccccgttacccg

SEQ ID NO: 274623 - DNA, 530 bp, Homo sapiens
  misc_feature: GYAE6OF02GSXI0.27.23.C01.1.454.CMB.1.raw
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattcttatgatgtcagtaatcggccccaggggtttctgatcgcttctatggctccaagtctgcctacacggcctccctgaccatctccgggctccagcctgagacgaggctgattattattgtagttcatatacaaccagtgactacttgggtgttcggcggagggaccaggctgaccgtcctaggtcaggcccaaggctcgccccgtcggtccactctcgttcccgccctcccg

SEQ ID NO: 274624 - DNA, 618 bp, Homo sapiens
  misc_feature: GYAE6OF02J01CG.27.23.C01.1.454.CMB.1.raw
  modified_base (226)..(226): a, c, t, g, unknown or other
  misc_feature (226)..(226): n is a, c, g, or t
tcagagcgtcgtctcacgaccggtgctcgatttagtacacgtgattaggattgggggtcgtcgaggaggcgagcgctctcgggacgtctccaccatggcctggctctgctattcctcaccctcctcactcaggcacaggtcctggcccagtctgccctgactcagcctgcctccgtgtctgggtctcctggacagtcgatcaccatctcctgcactggaaccccgngatgaccgttggtgcttataactttatctgttggtaccgacaggaccccaggcactgtccccaaactcattcttatgatgtcagtaatcggccccaggggtttctgatcgcttctatggctccaagtctgcctacacggtcctccctgacccatcctccgggctcccacgccttgacgggacgaggctgactttattattaggttatttccattactaactaaccctagtcgaactacgtttggggttagtttcgggacggtacggggacctacgggccgttagacccggttcctacgggttaccgaacggtccccaaagggtcccgttacggcccccccgttacggttaccgacccgtttccttccggtttcccccaaccccgtttccccg

SEQ ID NO: 274625 - DNA, 549 bp, Homo sapiens
  misc_feature: GYAE6OF02I17OP.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaacagtgacacttgggtgttcggcgggtagggaccgaggctgacccgtcgtaggtcgacggacccaagggctacgcccccgtcggtcctaccgtcctcggttccccgccctcccg

SEQ ID NO: 274626 - DNA, 532 bp, Homo sapiens
  misc_feature: GYAE6OF02IYYAD.27.23.C01.1.454.CMB.1.raw
tcagagcgtcgtctcacgaccggtgctcgatttagtacacgtgattagggattgggggggtctcaggaggcagcgctcccgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgagctgattattattgtagttcatatacaacagtgacacttgggtgttcgggcggagggaccaggctgaccgtccaggtcacgcccaaggctcgcccctcggtccacttcctcgttcccgccctcctccg

SEQ ID NO: 274627 - DNA, 536 bp, Homo sapiens
  misc_feature: GYAE6OF02FZW7A.27.23.C01.1.454.CMB.1.raw
  modified_base (531)..(531): a, c, t, g, unknown or other
  misc_feature (531)..(531): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatcctccgggctccagcctgaggacgaggctgtattattattgttagtttcaattactacaaccagtgactacgttgggtgtttcgggcggagggaccaggctgaccgtctaggtcagcccaaggcctcgccccgtgcactctcgttcccncctcc

SEQ ID NO: 274628 - DNA, 536 bp, Homo sapiens
  misc_feature: GYAE6OF02G7ABK.27.23.C01.1.454.CMB.1.raw
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccagggtttctgatcgcttctatggctccaagtctgcctacaccggcctccctgaccatcctccgggctccagcctgaggacgaggctgattattattgttagttcatatacaacagtgacacgttgggtgttcggcggagggaccaggcgtgaccgtccgtaggtcgacgcccaaggctcgccccgtcggtccacgtctcgttcccgccctccg

SEQ ID NO: 274629 - DNA, 532 bp, Homo sapiens
  misc_feature: GYAE6OF02I9LSR.27.23.C01.1.454.CMB.1.raw
  modified_base (228)..(228): a, c, t, g, unknown or other
  misc_feature (228)..(228): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtaccgacaggacccaggcactgtccccaaactcattctttatgatgtcagtaatcggccccagggtttctgatcgcttctatggctccaagtctgcctacacggcctccctgaccatctccgggctccacgcctgaggacgaggctgattatattgtagttnatatacaaccagtnacacttgggtgttcggcggagggaccaggctgaccgtcgtaggtccgagcccaaggcgtcgccccgtcggtcacctctcgttcccgccctcccg

SEQ ID NO: 274630 - DNA, 527 bp, Homo sapiens
  misc_feature: GYAE6OF02HKKUH.27.23.C01.1.454.CMB.1.raw
  modified_base (229)..(229): a, c, t, g, unknown or other
  misc_feature (229)..(229): n is a, c, g, or t
  modified_base (331)..(331): a, c, t, g, unknown or other
  misc_feature (331)..(331): n is a, c, g, or t
  modified_base (450)..(450): a, c, t, g, unknown or other
  misc_feature (450)..(450): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccngatgacgttggtgcttataactttatctgttggtaccgacaggacccaggcactgtccccaaactcattcttatgatgtcagtaatcggccccagggtttcngatcgcttctatggctccaagtctgcctacacggcctccctgaccatccgtccgggctccagcctgaggacgagctgattattattgtagttcatatacaaccagtgactacttgggtnttcgggcgagggaccaggctgaccgtctaggtcacgcccaaggctcgccccgtcggtcactctcgttcccgcctccc

SEQ ID NO: 274631 - DNA, 546 bp, Homo sapiens
  misc_feature: GYAE6OF02JMCP2.27.23.C01.1.454.CMB.1.raw
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaccncgatgacgttggtgcttaataactttanctgtgtaccgacaggacccaggcactggtccccaaactcattctttactgatgtcagtaatcggcccctaggggtttctgactcgcttctatggctcaagtctgctacacgcctcctgaccatctcgggctccagcctgacggacgaggctgattactatgttattcattagtacaaccagtgacacgtttgggtcgttcggcggacgggaccaggctagaccgttcgaggtcgaacggcccgaaggcctcgaccccgttcggtccacttcctcggttccccgcccttaccg

SEQ ID NO: 274632 - DNA, 529 bp, Homo sapiens
  misc_feature: GYAE6OF02GF3R5.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatcctccgggctccagcctgacggacgaggctgattatattgtagttcatatacaaccagtgacacgttgggtgttcggcggagggaccaggctgaccgtctaggtcagcccaaggctcgcccctcggtcacctctcgttcccacctccc

SEQ ID NO: 274633 - DNA, 535 bp, Homo sapiens
  misc_feature: GYAE6OF02GLIVW.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggccccagggtttctgatcgcttctatggctccaagtctgcctacacggcctccctgacccactcctcccgggctccgacgcctgaggacgaggctgattattattgttagttcattatacaacagtgactacgttgggtgttcggcggagggaccaggctgaccgtctaggtcagccaaggcctcgcccctcggtcactctcgttcccgcctccg

SEQ ID NO: 274634 - DNA, 529 bp, Homo sapiens
  misc_feature: GYAE6OF02ILWVG.27.23.C01.1.454.CMB.1.raw
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggccccagggtttctgatcgcttctatggctccaagtctgcctacacggcctccctgacccatcctccgggctccagccctgaggacgaggctgattattattgttagttcatatacaaccagtgactacttgggtgttcggcggagggaccaggctgaccgtctaggtcagcccaaggctcgcccctcggtcactctcgttcccaccctcc

SEQ ID NO: 274635 - DNA, 544 bp, Homo sapiens
  misc_feature: GYAE6OF02G9LPL.27.23.C01.1.454.CMB.1.raw
  modified_base (444)..(444): a, c, t, g, unknown or other
  misc_feature (444)..(444): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatcctccgggctccacgcctggacggacgaggctgatttattattgttagttcatatacaaccngtgactacgttgggtgttcggcggagggaccaggctgaccgtcgtaggtcgacgacccaaggctacgccccgtcggtccactcgtcgttcccaccttccc

SEQ ID NO: 274636 - DNA, 536 bp, Homo sapiens
  misc_feature: GYAE6OF02FZ3U9.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctcaagtctgcctacacggcctcctgaccatcctccggctccagcctgaggacgaggctgtattattattgttagttcattatacaaccagtgactacgttgggtgttcggcggacgggaccaggctgaccgtcgtaggtcgacgcccaaggcctcgccccgtcgtccactctcgttcccgccctccg

SEQ ID NO: 274637 - DNA, 540 bp, Homo sapiens
  misc_feature: GYAE6OF02GW760.27.23.C01.1.454.CMB.1.raw
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgttagttcatatacaaccagtgacacttgggtgttcggcggtagggaccaggctgacccgttccgtaggtcgaaggcccaaggctcggccccctcggtccacctctcgttccccgccctcccg

SEQ ID NO: 274638 - DNA, 669 bp, Homo sapiens
  misc_feature: GYAE6OF02IZJQU.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgacttataactttatcttgttggtaccgacaggacccaggcactcgtacccccaaactctatttctttatgtatgtcagtaactccggaccccgtagggtttctgatcgcttctagtggtctaccaagtctcgcctacgacggtcctcccgtcgacctactccgtcccgggctccgagtcccgtagacgggacgaggtctaggtatttattattgttacgttactaatactaaccaaacctaggtagtactaacggtttggggtacgttcggggacgggtaacgggaccgaacgggccgtacgggtacccgttacgttaacgggtaccgtaacggaccccgtaaacgggtcccgttcccggtccccccgtttcgggtaccctacccgttcccgtttacccggttacccccctaccccgttaccccg

SEQ ID NO: 274639 - DNA, 534 bp, Homo sapiens
  misc_feature: GYAE6OF02G2RSI.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccggctccagcctgaggacgaggctgattattattgtagttcatatacaacagtagactacgttgggtgttcgggcggagggaccaggctgaccgtctaggtcaggccaaggctcgccccctcggtcacctccgtcgttcccaccctcc

SEQ ID NO: 274640 - DNA, 535 bp, Homo sapiens
  misc_feature: GYAE6OF02H2DV6.27.23.C01.1.454.CMB.1.raw
  modified_base (332)..(332): a, c, t, g, unknown or other
  misc_feature (332)..(332): n is a, c, g, or t
  modified_base (439)..(439): a, c, t, g, unknown or other
  misc_feature (439)..(439): n is a, c, g, or t
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggccccagggtttcngatcgcttctatggctccaagtctgcctacacggcctccctgaccatcctccgggctccagcctgaggacgaggctgattattattgtagttcatatacaaccagtnacacgttgggtgttcggcggagggccaggctgaccgtccgtaggtcagcccaaggcctacgccccgtcggtcaccttctcgttccccaccctcccg

SEQ ID NO: 274641 - DNA, 544 bp, Homo sapiens
  misc_feature: GYAE6OF02GD49R.27.23.C01.1.454.CMB.1.raw
  modified_base (227)..(227): a, c, t, g, unknown or other
  misc_feature (227)..(227): n is a, c, g, or t
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtaccgacaggacccaggcactgtccccaaactcattctttatgatgtcagtaatcggccccaggggtttctgatcgcttctatggctccaagtctgccctacacggcctccctgaccatcctccgggctccagcctgaggacgaggctgattattattgtagttcatatacaaccagtgacacttgggtgttcggcggagggaccaggcgtgaccgtccgtaggtccaggtcccaaggcctacgccccctcggtccaccttcctcggttccccacccttcccg

SEQ ID NO: 274642 - DNA, 543 bp, Homo sapiens
  misc_feature: GYAE6OF02H99GN.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtaccccaaactcattctttatgtatgtcagtaatcggcccctaggggtttctgtatcgcttctatcggcttccaagtctcgcctacacggcctccctgaccatctccgggctcagcctgaggacgaggctagattattattgtagttcatatacaaccagtgactagttgggtcgttcggcggaggaccgaggctacgaccgtcctaggtccgacgccaaggcctacgccccgtcgccactctcgttccccacctccg

SEQ ID NO: 274643 - DNA, 553 bp, Homo sapiens
  misc_feature: GYAE6OF02H5662.27.23.C01.1.454.CMB.1.raw
  modified_base (365)..(365): a, c, t, g, unknown or other
  misc_feature (365)..(365): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggccccagggtttctgatcgcttctatggctccaagtctgcctacncggcctccctgaccatcctccggctccagcctgaggacgaggctgattattattgtagttcattatacacagtgactacttgggtcgttcgggcggacgggacaggctgtacccgtcgtaggtacgacgacccgaacgggtcctcggaccccctcgggtaccaccttcgtccgttcccgcccttcccg

SEQ ID NO: 274644 - DNA, 536 bp, Homo sapiens
  misc_feature: GYAE6OF02FFMGY.27.23.C01.1.454.CMB.1.raw
  modified_base (244)..(244): a, c, t, g, unknown or other
  misc_feature (244)..(244): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactgggaaccccgcgatgacgttggngcttataactttatctgttggtacgacaggacccaggcactgtccccaaactcattctttatgatgtcagtaatcggcccccaggggtttctgatcgcttctatggctccaagtctgcctacacggcctccctgaccatctccgggctccagcctgaggacgaggctgatatattgtattcatatacaaccagtgacacgttgggtgtttcgggcggtagggaccaggctgaccgttcctaggtcagcccaaggctcgccccgtcggtccacctctcgttcccaccctcccg

SEQ ID NO: 274645 - DNA, 563 bp, Homo sapiens
  misc_feature: GYAE6OF02HZCK6.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggccccaggggtttctgatcgcttctatgctcaagtctgcctacacggcctccctgaccatcctccgggctccagcctgaggacgaggctgattattattgtagttcatatacaacagtgacacgttgggtgttcgggcggtagggaccgaggctcgaccgtaccgtagggttcaggtccccgaagggtcccttcgccccccgttcggtccctaccgttccgttcgtttcccccgcccttaccccg

SEQ ID NO: 274646 - DNA, 597 bp, Homo sapiens
  misc_feature: GYAE6OF02H2VRJ.27.23.C01.1.454.CMB.1.raw
  modified_base (336)..(336): a, c, t, g, unknown or other
  misc_feature (336)..(336): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttgtaccgacaggaccaggcactcgtccccaatcattctttatgtatgtcagtaatccggcccccgtaggggtttcngtatcgtcttctagtcggcctccaagtctcgtccctacgaccggtccctccctgacccatccgtcccgggcctccacgtccgtggacggacgaggtctagatttattattggtacgtttcaatactaacaacagtcgaacgtacgtttgggtcgttcgggaccgggtagggaccaggtcctcggaccgttccgtaggtccacggtcccgaaggccttccgcccccgtggttcccacgttccgtcgttcccccaccctcccg

SEQ ID NO: 274647 - DNA, 566 bp, Homo sapiens
  misc_feature: GYAE6OF02F2SRS.27.23.C01.1.454.CMB.1.raw
  modified_base (227)..(227): a, c, t, g, unknown or other
  misc_feature (227)..(227): n is a, c, g, or t
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtaccgacaggacccaggcactgtcccaaactcattctttatgatgtcagtaatcggccccagggtttctgatcgcttctatggctccaagtctgcctacacggcctccctgaccatcctccgggctccagccctgacggacgaggctgattatattgtagttcatatacaacagtgacattgggtgttcggcgggtacgggaccagggctacgaccgtccgtaacggtccgtaacgccccgtaagggcccgttacgccccccgttcggtccgaaccttccgttccggttccccgccccttccccg

SEQ ID NO: 274648 - DNA, 552 bp, Homo sapiens
  misc_feature: GYAE6OF02GLN9B.27.23.C01.1.454.CMB.1.raw
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttntctgttggtaccgacaggaccaggcactgtccccaactcattctttatgatgtcagtaatcggcccctagggtttctgatcgtcttctatgctccaagtctgcctacacggcctccctgaccatcctccgggctccgacgcctgaggacgagctgattatattgtatctatactacaaccagtgacacgttgggtagttcgggcggtaggaccaggcgtagaccgtcgtacggtcacggacccaacggtcctacgcccccgtcggtcctaccgtcgttccgttcccctaccctcccg

SEQ ID NO: 274649 - DNA, 556 bp, Homo sapiens
  misc_feature: GYAE6OF02GZPJN.27.23.C01.1.454.CMB.1.raw
  modified_base (333)..(333): a, c, t, g, unknown or other
  misc_feature (333)..(333): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttcngatcgcttctatggctccaagtctgcctacacggcctccctgacccatcctcccgggctccacgcctggacggacgaggctgattattattgttagttcatatacaacctagtgactacgttgggtgttcgggcggacgggaccaggctggacccgtccgtaggtccgacggcccgaacggcctcgcccccgtcggtccaccgttctcgttccccaccctccc

SEQ ID NO: 274650 - DNA, 705 bp, Homo sapiens
  misc_feature: GYAE6OF02IKCZW.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataactttatctgttggtaccgacaggacccaggcactcgtaccccaaactctattctttatgtatgtcagtactccggccccgtaggggtttctgactcgtcttctatcggctaccaagttctcgtaccctacgaccggtccctccctacgaccctacgtccgtcccgggtcctccgacgtcccgtaggacggacggacggtactagtaatttacgttagtttggttaacgtttcaattaacttaaccgaaaccgtagttacgaaccgttaacggtttggggttacggttaccgggacggggtaacgggtaccgagggtccgtacggtacccggttaccgttacgggtccgtaaccggaccccggtaaacgggtcccgttacccggtaccccccggtttccgggtacccttacccggttcccgttacccggtttaccccccctaaccccgttccccg

SEQ ID NO: 274651 - DNA, 574 bp, Homo sapiens
  misc_feature: GYAE6OF02H2UZA.27.23.C01.1.454.CMB.1.raw
  modified_base (422)..(422): a, c, t, g, unknown or other
  misc_feature (422)..(422): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataacttttatcttgttggtaccgacaggacccaggcactgtccccaaactcattctttatgatgtcagtaatccggcccctaggggtttctgatcgcttctatggctcaagtctgcctacacggcctccctgaccatcctccgggctccgagcctgacggcgaggctgattattnttgtagttcatatacacagtgacacgttgggtgttcgggcggagggaccgaggcctggaccgttccgtagggttccaacggccccgaagggtccctaccgccccccgttcgggtacctaccgttccgtccggtttcccccgtcccttccccg

SEQ ID NO: 274652 - DNA, 536 bp, Homo sapiens
  misc_feature: GYAE6OF02I51OO.27.23.C01.1.454.CMB.1.raw
  modified_base (334)..(334): a, c, t, g, unknown or other
  misc_feature (334)..(334): n is a, c, g, or t
tcagagcgtcgtctcacgaccggtgctcgatttagtacacgtgattagggagttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttcngatcgcttctatggctcaagtctgcctacacggcctcctgaccatcgtccggctccagcctgaggacgaggctgattattattgtagttcattatacaaccagtcgacacgttgggtcgtttcgggcgggagggaccaggctgaccgtctaggtcgacgcccaaggctcgcccctcggtccactctcgttccccgccctccg

SEQ ID NO: 274653 - DNA, 549 bp, Homo sapiens
  misc_feature: GYAE6OF02G83F5.27.23.C01.1.454.CMB.1.raw
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattcttatgatgtcagtaatcggccccagggtttctgatcgcttctatggctccaagtctgcctacacggcctccctgaccatcctccgggctcccacgcctgacggacgaggctgattattattgtagttcatatacaacagtgacacttgggtgttcggcgggtagggaccgaggctgaccgtcgtaggtcacggcccaacggcctcgccccctcggttccaccgttcgtccggtttccccgcccttcccg

SEQ ID NO: 274654 - DNA, 528 bp, Homo sapiens
  misc_feature: GYAE6OF02G7ZSL.27.23.C01.1.454.CMB.1.raw
  modified_base (242)..(242): a, c, t, g, unknown or other
  misc_feature (242)..(242): n is a, c, g, or t
  modified_base (482)..(482): a, c, t, g, unknown or other
  misc_feature (482)..(482): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggngcttataactttatctgttgtaccgacaggacccaggcactgtccccaaactcattctttatgatgtcagtaatcggccccagggtttctgatcgcttctatggctccaagtctgcctacacggcctcctgaccatctccgggctccagcctgaggacgaggctgattatattgtagttcatatacaacagtgacacttgggtgttcggcggagggccaggctagaccgtcgtaggtccnggacccaaggcctcgcccctcggtcactcctcgttccccgcctccg

SEQ ID NO: 274655 - DNA, 662 bp, Homo sapiens
  misc_feature: GYAE6OF02JILWZ.27.23.C01.1.454.CMB.1.raw
  modified_base (262)..(262): a, c, t, g, unknown or other
  misc_feature (262)..(262): n is a, c, g, or t
  modified_base (653)..(653): a, c, t, g, unknown or other
  misc_feature (653)..(653): n is a, c, g, or t
tcagagcgtcgtctcacgaccggtgctcgatttagtacacgtgattagggagttgggggggtcggtcgaggaggcgagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataaacttttntcttgttgtaccgacaggaccaggcactcgtccccaaactctaattctttatgtattgtcagtaactccggccccctaggggtttctgactcgtcttctagtggcctcctaagtctgtcctacacggccctcccttcgaccctatccgtccgggtcctacccgacgtccctaggacggaccggtaggccttagtaacgtttattaaggtttcgttaacgtttactagttaacttaacgaaaccctaggtacgaactaccgtttggggttcgttcggggtacgggaacgggtaccgaggtccgtaggttaacccgtcgttaacgggcctacggtaccccaagggtcccttacggccccccgttgggtccaccgttcccttcggttacccccncccttccgg

SEQ ID NO: 274656 - DNA, 529 bp, Homo sapiens
  misc_feature: GYAE6OF02I1N4S.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattatattgtagttcatatacaaccagtgacacttgggtgttcggcggagggaccaggctgaccgtcctaggtcagcccaaaggctgccccctcggtcactctgttcccgccctccc

SEQ ID NO: 274657 - DNA, 532 bp, Homo sapiens
  misc_feature: GYAE6OF02GIZXQ.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataacttttatctgttggtaccgacaggacccaggcactgtccccaaactcattctttatgatgtcagtaatcggccccaggggtttctgatcgcttctatggctcaagtctgcctacacggcctccctgaccatctccgggctccagcctgaggacgaggctgattattattgttagttcatatacaaccagtgacacttgggtgttcggcggagggaccaggctgaccgtctaggtcacgccaaggctcgccccgtcggtccactctcgttccccgcctcccg

SEQ ID NO: 274658 - DNA, 535 bp, Homo sapiens
  misc_feature: GYAE6OF02I4W70.27.23.C01.1.454.CMB.1.raw
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctcaagtctgcctacacggcctcctgaccatctccgggctccagcctgacggacgaggctgattattattgtagttcatatacaaccagtgactacgttgggtgttcggcggtacgggaccaggctgaccgtctaggtcacggcccaaggcctcgcccctcggtcctactctcgttccccaccctccg

SEQ ID NO: 274659 - DNA, 541 bp, Homo sapiens
  misc_feature: GYAE6OF02GN8SD.27.23.C01.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataactttntctgttggtacgacaggacccaggcactgtccccaaactcattctttatgatgtcagtaactccggccccagggtttctgatcgcttctatggctcaagtctgcctacacggcctcctgaccatcctccgggcctccgacgcctggacggacgaggctgtattattattgtagttcatatacaactagtgactacgttgggtgttcgggcggagggaccaggctcgaccgtctaggtcacgcccgaaggcctcgcccctcggccacctccgtcgttcccgccctccc

SEQ ID NO: 274660 - DNA, 553 bp, Homo sapiens
  misc_feature: GYAE6OF02JTTJC.27.23.C01.1.454.CMB.1.raw
  modified_base (439)..(439): a, c, t, g, unknown or other
  misc_feature (439)..(439): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttgtaccgacaggaccaggcactgtccccaaactcattcttatgatgtcagtaatcggccccagggttctgatcgcttctatggctcaagtctgcctacacgcctcctgaccatctccgggctccagccctgacggacgaggctacgtatttattattgtagtttcatactacaaccagtnactacgttgggtgttcggcggagggaccaggactgaccgtcgtaggtcgacggtacccaagggtcctacgtcccccgtacggttcacgtttcctcggttccccgcccttacccg

SEQ ID NO: 274661 - DNA, 698 bp, Homo sapiens
  misc_feature: GYAE6OF02INDHB.27.23.C01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcactcctctgactacgtaccggaacccgngtagtacggtacggttggtcgtactttaaactttaacttttacttcgtttggtttaccggtaacccgaacgaaccggaacccgacggacctacgtcccgtaacccccaaactcttacttttactttagtagtagtcgtactaagttaaccgtcccggaccccggttagggtttctagtactcgtctcttagtcgcctacgacgttcgtcgtacctacgaccgtccctacccgtacgacctactcccggtccggtcctacccgacgtccgtaggacggacggtacgtcgtagtatttagttagttgttacgttctaaatactaaccaacgtgtacacgttacggtttgggttcggttcgggacggtacggacgacgtcgtacgtaccgtacgtacggtacacccgacgtaacgtccgtacccgtccccggtcgtactacccgttctcccgtaccctaccccg

SEQ ID NO: 274662 - DNA, 560 bp, Homo sapiens
  misc_feature: GYAE6OF02HPGIU.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgctttataactttatctgttggtaccgacaggaccccaggcactgtccccaaactcattctttatgatgtcagtaatcggcccctaggggtttctgatcgcttctatggctcaagtctgcctacacggcctccctgaccatcgtccgggctccgagccgtgacggacgaggctgatttattattgttagttcaattataacaaccagtcgactacgtttgggtgttcgggcggagggaccaggctacgaccgtccgtaggtccacgcccgaaggcctcggccccttcggtccaccgtcgtcgttccccacccttccg

SEQ ID NO: 274663 - DNA, 612 bp, Homo sapiens
  misc_feature: GYAE6OF02J1U31.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattgggggggtcgtcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgctttataactttatctgttgtaccgacaggaccaggcactgtccccaaactcattcttatgatgtcagtaactccggccccctaggggtttacctgactcgtcttctatcggctaccagtctgcctacacggccctccctgacccatccgtccgggctcccgagccctggacggacgaggctgtattattattgttacgtttcattactaacaaccagtgactacgttgggttgttcgggcggtacgggacctacggcgttacgtaccgtaccgtaggttaccgacggacccgaacgggcccgttaccggccccccgttacgggtccctaccgttaccgttcccgtttcccccgtaccccttccccg

SEQ ID NO: 274664 - DNA, 528 bp, Homo sapiens
  misc_feature: GYAE6OF02F1S87.27.23.C01.1.454.CMB.1.raw
  modified_base (228)..(228): a, c, t, g, unknown or other
  misc_feature (228)..(228): n is a, c, g, or t
  modified_base (523)..(523): a, c, t, g, unknown or other
  misc_feature (523)..(523): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtaccgacaggacccaggcactgtccccaaactcattctttatgatgtcagtaatcggccccaggggtttctgatcgcttctatggctcaagtctgcctacacggcctccctgaccatctccgggctccagcctgacggacgaggctgattattattgttagttcattatacaaccagtgacacgttgggtgttcggcggagggaccaggctgaccgtctaggtcagcccaaggctcgcccctcggtcacgtctcgttcccncctcc

SEQ ID NO: 274665 - DNA, 623 bp, Homo sapiens
  misc_feature: GYAE6OF02IX7Z7.27.23.C01.1.454.CMB.1.raw
  modified_base (202)..(202): a, c, t, g, unknown or other
  misc_feature (202)..(202): n is a, c, g, or t
tcagagcgtcgtctcacgaccggtgctcgatttagtacacgtgattagggagttgggggggtcgtcgaggaggcgagcgctctcgggacgtctccaccatggcctgggctctgctattcctcaccctcctcactcagggcacagggtcctgggcccagtctgccctgactcagcctgcctccgtgtctgggtctcctggacngtcgatcacatcctcctgcactggaaccccgcgatgacgtttggtgctttataacttttatctgttggtaccgacaggacccaggcactcgtccccaaactcattctttactgtatgtcagtatccggcccctagggtttctgatcgtcttctatggctacagtctcgaccttacacggtcctccctcgacccatccgtcggcctccgacgtcctgacggtacgacggactgtattattattgtagttcattataccaactagtacactacgttgggtacgttcgggtcggaggtaccgtacggcgttacggacccgttacgtacggttacgaccggtacccgtaacgggtaccctcggtaccccccttcggggttaccctacccgttccgttaccggtttcccccggacccccttcccgg

SEQ ID NO: 274666 - DNA, 565 bp, Homo sapiens
  misc_feature: GYAE6OF02HPPVL.27.23.C01.1.454.CMB.1.raw
  modified_base (464)..(464): a, c, t, g, unknown or other
  misc_feature (464)..(464): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatccggcccctaggggtttctgatcgcttctatggctccaagtctgcctacaccggcctccctgaccctactccgtcccgggcctcccgacgccctggacgggaccggaggctggatttattattgttagtttcattatacaaccagtnactagttgggtgttcggcggaggaccgaggctgacccgtcgtaggtcgacgcccaaggcctccgccccgtcggtccacttcctccgttcccacccttcccg

SEQ ID NO: 274667 - DNA, 546 bp, Homo sapiens
  misc_feature: GYAE6OF02JLYR6.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggncttataactttatctgttggtaccgacaggacccaggcactgtccccaaactcatctttatgatgtcagtaatcggccccagggtttctgatcgcttctatggctccaagtctgccctacacggcctccctgaccatctccggctccagcctgacggacgaggtctgtattattattgttagtttcaagttatacaaccagtcgaactacttgggtagtttcggcggacgggaccaggctgaccgtctaggtcgacgccaacggctcgccccgtcggtccactcctcgttccccaccccgttcc

SEQ ID NO: 274668 - DNA, 556 bp, Homo sapiens
  misc_feature: GYAE6OF02F3AGE.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgctttataactttatctgttggtacgacaggacccaggcactgtccccaaactcattctttatgatgtcagtaatcggccccagggtttctgatcgcttctatggctcaaagtctgcctacacggcctccctgaccatcctccgggctccacgcctgaggacgaggctggattatattgtagttcatatacaaccagtcgactacgttgggtgttcgggcggagggaccaggcgtcgaccgtccgtaggtcgacggaccctaaggcctacgcccccttacggtccaccgttcctcggttccccgcccttcccg

SEQ ID NO: 274669 - DNA, 532 bp, Homo sapiens
  misc_feature: GYAE6OF02GI318.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggccccagggtttctgatcgcttctatggctcaagtctgcctacacggcctccctgaccatcctccgggctccagcctgacggacgaggctgattattattgtagttcatatacaaccagtgacacgttgggtgttcggcggagggccaggctcgaccgtcgtaggtcacgcccaaggcctcgcccctcggtcattcgtcgttcccgcctccg

SEQ ID NO: 274670 - DNA, 550 bp, Homo sapiens
  misc_feature: GYAE6OF02HSCRJ.27.23.C01.1.454.CMB.1.raw
  modified_base (229)..(229): a, c, t, g, unknown or other
  misc_feature (229)..(229): n is a, c, g, or t
  modified_base (333)..(333): a, c, t, g, unknown or other
  misc_feature (333)..(333): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataactttatctgttggtaccgacaggacccaggcactgtccccaaactcattctttatgatgtcagtatccggcccctagggtttcngatcgcttctatgctacagtctgcctacacggcctcctcgacctactccgtccgggctccagcctgaggacgngctgattattnttgttatnatataacacagtgactacgttgggtcgttcggcggaggaccgaggtcgtacgaccgtcgtaggtacacgaccgtaggcctccgccccgttcggtctaccgttccgtaccgttccccaccctcccg

SEQ ID NO: 274671 - DNA, 845 bp, Homo sapiens
  misc_feature: GYAE6OF02FD7NL.27.23.C01.1.454.CMB.1.raw
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (328)..(328): a, c, t, g, unknown or other
  misc_feature (328)..(328): n is a, c, g, or t
  modified_base (369)..(369): a, c, t, g, unknown or other
  misc_feature (369)..(369): n is a, c, g, or t
tcagagcgtcgtctcacgaccggtgctcgatttagtacacgtgattagggagttgggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatcctcctgccacgtcggaaccccgngtatcggtacgttggtntactttataacttagtctggttacggtaccgacgacggaccaggcctactccgtaccccaaactctattcttagngtatcgtacgtacggtaccgtcccggtcccgtagggtttcngtactcgtcttacgtagtcggtacctaccgacgtccgtaccgtaccctaaccgcccggtccccttcccgtacgtacccgtacgttcccggtacccgggtacctacccggtacgtaccggtacgggaaacgggtaaccgttaacggttactttaaggtttaaacttttaacgtttaacgtttacggttaaaccgttaaccttaaaccgttaaaccgtaaacccgtaaaccggttagggtaaccggttaaaccggttcgggttttaccgggggtaccggttacccgggggaaccgggtaaccgggtacctacggggttaccgttaccccgggtaacccgttaccggtaaccggtacccggtaaacccggtacccccggtaacccgggttccccgttaccccggtacccccggttaccggttacccctaccccgtttaccccgttacccccggttacccccgtacccggttaaccccgg

SEQ ID NO: 274672 - DNA, 546 bp, Homo sapiens
  misc_feature: GYAE6OF02HZ568.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatcttgttggtaccgacaggacccaggcactgtccccaaactcattctttatgatgtcagtatccggcccctaggggtttctgtatcgcttctatggctcaagtctcgcctacacggcctccctgaccatctcccgggctccagcctgaggacgaggctgtattattattgtagtttcatatacacagtgactacgttggtgttcggcggaggccgaggctgaccgtcgtaggtcgagcccgaaggcctcgcccccgtcggtccaccgttcgtcgttccccacccttcccg

SEQ ID NO: 274673 - DNA, 617 bp, Homo sapiens
  misc_feature: GYAE6OF02JKIYY.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaacccngatgacgttggtncttataactttntctgttggtaccgacaggacccaggcactgtaccccaaactcattctttatgatgtcagtaatccggcccctagggtttctgatcgtcttctatggctccaagtctcgcctacgacggtcctccctgacccatccgtccgggctcacgccgtgaacggcgaggctcgtatttattactttgttacgttctactacgtaacaacctagtacgacctacgttgggtacggtttcggacggggtacgggaccgaggtccgtacggtaccgtccgtacggttacgaccggtaccgaaacgggtccgtaccggtacccccgtcggttacccgaccgttaccgttccgttacccctaccccttcccg

SEQ ID NO: 274674 - DNA, 620 bp, Homo sapiens
  misc_feature: GYAE6OF02IWUMT.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactcgtccccaaactcattctttatgatgtcagtaatccggcccctaggggtttctgatcgcttctatggctaccaagtctgcctacgaccggtcctcccgtcgaccagtccgtccggctcccagcctaggaggacggaggctagtatttagttattgtagttcagtactacaaccagtgactacgttggggtcgttcgggacggtacgggaccgacgggtctacggtacccgttaccggtacggtccgaacggtacccgaacgggtccttacccggccccccgttacgggttccctaccgttcccgtcccgttttacccccaaccccgtttccccg

SEQ ID NO: 274675 - DNA, 628 bp, Homo sapiens
  misc_feature: GYAE6OF02IO1MN.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggagttggggggggtctcaggaggcacgcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattcttatgatgtcagtaatccggcccctagggttctgatcgcttcatggctcagtctgcctacacggcctcctgaccatccgtccggctccacgtcctgacggacgaggtctgtattacgttattgttagtttacagttactaacaaccgtagtacgaacttacgtttggggtcggttaccgggacgggtacgggtaacccggaggtacgttcggacccgttccgtaacgggtccgaacggtaccccgaaagggttcccgtaccggtaccccccgttcggggttaccctaccgttcccgttaccggtttcccccgcccccttaccccgg

SEQ ID NO: 274676 - DNA, 585 bp, Homo sapiens
  misc_feature: GYAE6OF02FQMAV.27.23.C01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtacgacaggacccaggcactcgtccccaaactcatttctttatgatgtcagtaatccggccccgtagggtttctgatcgcttctatgctcaagtctgcctacacggcctcctgaccatccgtccgggctccgacgcctggacggacgaggctagtattattattgttagttctattatacaacctagtacgactacgttgggttcgttcgggacggacgggaccagggtctacggaccgttccgtacggtcgacggacccgaagggtcctaccggcccccgtacggtcccgtaccgttccgttacgttccccgtcccttcccg

SEQ ID NO: 274677 - DNA, 541 bp, Homo sapiens
  misc_feature: GYAE6OF02FZ8L0.27.23.C01.1.454.CMB.1.raw
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggaccaggcactgtccccaaactcattctttatgatgtcagtaatcggccccagggtttctgatcgcttctatggctcaagtctgcctacacggcctccctgaccatctccgggctccagcctgaggacgaggctgattatattgttagttcatatacaaccagtagacacttgggtcgttcgggcggtagggaccaggctgaccgtctaggtcacgcccaaggctcgcccccgttcggtccaccgttcgtcgttcccgcccttcccg

SEQ ID NO: 274678 - DNA, 581 bp, Homo sapiens
  misc_feature: GYAE6OF02GKA6L.27.23.C01.1.454.CMB.1.raw
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctcaagtctgcctacacggcctccctgaccatcctccgggctccacgcctgacggacgaggctgatttattattgttagttcatatacaacctagtgactacgttggggtcgttcgggacgggagggtaccagggtccgtagacccggttcctagggtccaacggtccccgaacgggtccttccggcccccgttcggtccctaccgttccgtccggtttccccgcccttccccg

SEQ ID NO: 274679 - DNA, 555 bp, Homo sapiens
  misc_feature: GYAE6OF02HF7GE.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaactcggcccctaggggtttctgatcgcttctatggctccaagtctgcctacacggcctccctgaccatcctccgggctccacgcctgaggacgaggctagattattattgttagttcatatacaaccagtgactacgttgggtgttcggcggagggaccaggcgtcgaccgtccgtaggtccgacggcccaaggcctcggccccttcggtccaccgttcgtccgttccccgccctcccg

SEQ ID NO: 274680 - DNA, 534 bp, Homo sapiens
  misc_feature: GYAE6OF02GITSE.27.23.C01.1.454.CMB.1.raw
  modified_base (230)..(230): a, c, t, g, unknown or other
  misc_feature (230)..(230): n is a, c, g, or t
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggccccagggtttctgatcgcttctatggctccaagtctgcctacacggcctccctgaccatcctccgggctccagcctgaggacgaggctgattattattgttagttcattatacaacagtgactacgttgggtgttcggcgggagggaccaggctgaccgtccgtaggtcgagcccgaaggcctcgcccctcggtcnctctcgttcccncctcc

SEQ ID NO: 274681 - DNA, 542 bp, Homo sapiens
  misc_feature: GYAE6OF02G3GCR.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgtttggtgctttataacttttatctgttggtaccgacaggaccccaggcactgtcccccaaactcattctttatgatgtcagtaatcggcccccaggggtttctgatcgcttctatggctccaagtctgcctacacggcctccctgaccatctccgggctcccagcctgaggacgaggctgattattattgtagttcatatacaacagtgacacgtttgggtgttcggcggagggaccgaggctgaccgtctaggtcacgcccaaggcctcgcccctcggtccactcctcgttccccgcctcccg

SEQ ID NO: 274682 - DNA, 678 bp, Homo sapiens
  misc_feature: GYAE6OF02IWKG0.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtaccccaaactctattctttatgatgtacagtaactccggccccgtaggggtttctgtactcgtcttctagtcggctacagtctcgccctacgaccggtcctccctgacctacgtccgtccgggctccgacgtccgtaggacggacggaggtcgttagtaactttagttagttaggttaagtttacctaattaactaaccaaccgtaggttacgaacgttacggtttcggggttacggttccggggacggggtacggggtaccgtacgggtccgttacggtacccggttcgtaacgggtccgaacggtacccgtaacgggtcccgttacccggtcccccgttcgggtacctacccgttaccgtttcccggtttaccccctacccgttacccg

SEQ ID NO: 274683 - DNA, 544 bp, Homo sapiens
  misc_feature: GYAE6OF02JI11T.27.23.C01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (436)..(436): a, c, t, g, unknown or other
  misc_feature (436)..(436): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttntctgttggtaccgacaggacccaggcactgtccccaaactcattctttatgatgtcagtaatcggccccagggtttctgatcgcttctatggctccaagtctgctacacggcctccctgaccatctccgggctccagcctgacggacgagctgattattattgttagttcatatacaaccngtgacacttgggtgttcggcggacgggaccgtaggcgtgtacccgtcttaggccaggaccctaggccctgccccctcggtccaccttcgtcgttccccacccttcccg

SEQ ID NO: 274684 - DNA, 538 bp, Homo sapiens
  misc_feature: GYAE6OF02FQALI.27.23.C01.1.454.CMB.1.raw
  modified_base (448)..(448): a, c, t, g, unknown or other
  misc_feature (448)..(448): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgctttataactttatctgttggtaccgacaggacccaggcactgtccccaaactcattctttatgatgtcagtaatcggccccagggtttctgatcgcttctatggctccaagtctgcctacacggcctccctgaccatcctccgggctccgagcctgacggacgaggctgacttattattgttagttcattatacaacctagtnacacgttgggtcgttcggcgggtaggaccaggctgaccgtcaggtcacgccaaggctcgccccgtggtcactcgtcgtcccgcctacccg

SEQ ID NO: 274685 - DNA, 569 bp, Homo sapiens
  misc_feature: GYAE6OF02I9CAD.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattgggggggtctcaggaggcagtgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccccncgatgacgttggtgcttataactttatctgttggtaccgacaggacccaggcactgtccccaaactcattctttatgatgtcagtaatcggcccccaggggtttctgatcgcttctatggctccaagtctgccctacacggcctccctgacccactccgtccgggctcccgagcctgaggacgaggctgattattattgtagttcattactactaaccagtcgaacacgtttgggtgttcgggcgggacgggacaggccgtgacccgtcgtaggtccaggcccgaaggcctcgtcccccgtcggttacctaccgttccgtcgtttccccgcccttacccg

SEQ ID NO: 274686 - DNA, 551 bp, Homo sapiens
  misc_feature: GYAE6OF02HTVO0.27.23.C01.1.454.CMB.1.raw
  modified_base (229)..(229): a, c, t, g, unknown or other
  misc_feature (229)..(229): n is a, c, g, or t
  modified_base (378)..(378): a, c, t, g, unknown or other
  misc_feature (378)..(378): n is a, c, g, or t
  modified_base (435)..(435): a, c, t, g, unknown or other
  misc_feature (435)..(435): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataacttttatcttgttggtaccgacaggacccaggcactcgtccccaaactcattctttatgatgtcagtaatccggcccctaggggttctgatcgcttctatggctcagtctgcctacacggcctcccgtnaccatcgtccgggctccacgcctgacggacgaggctgattattattgtattcattanacaacagtcgactacgttgggtgttcggcggtagggaccaggctcgaccgtccgtaggtccaaggcccgaaggcctcggtcccctcggtccaccttcgtccgttcccacccttccg

SEQ ID NO: 274687 - DNA, 581 bp, Homo sapiens
  misc_feature: GYAE6OF02HUI01.27.23.C01.1.454.CMB.1.raw
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (386)..(386): a, c, t, g, unknown or other
  misc_feature (386)..(386): n is a, c, g, or t
  modified_base (489)..(489): a, c, t, g, unknown or other
  misc_feature (489)..(489): n is a, c, g, or t
tcagagcgtcgtctcacgaccggtgctcgatttagtacacgtgattagggagttgggggggtcgtcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctagcatggaacccgngtatgacgttggtgcttaataactttntcttgttggtaccgacaggaccaggcactgtcccaaactcattctttatgtatgtcagtaatcgcccctagggttcctgatcgctctatcggctcaagttctgacctacacggcctcctcgacactcnccgggtctcacgcgtcgaggacgaggctagattattatgttacgttcattacactaccagtgtacaacgttcggtacgttcggtcgggacggtaccgaggacncgtaccgtcccgtaggtccgacggtacccaggtccgtaccgcccccttccggtccgtacccttacgtcgttttaccccaccccgttaccccg

SEQ ID NO: 274688 - DNA, 560 bp, Homo sapiens
  misc_feature: GYAE6OF02FVM5N.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattcttatgatgtcagtaatcggcccctagggtttctgatcgcttctatggctccaagtctgcctacacggcctcctgaccatctccggctccagcctgacggacgaggctagtattattagttgtagttcaattataacaacctagtgacgtacgttgggtgttcgggcggagggacaggcgtacgaccgtcgtacggtcacggcccaacgggcctaccggccccttcggtcctaccgttccgtccgttcccggtccctcccg

SEQ ID NO: 274689 - DNA, 615 bp, Homo sapiens
  misc_feature: GYAE6OF02I8OTL.27.23.C01.1.454.CMB.1.raw
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttaataactttatcttgttggtaccgacaggacccaggcactgtccccaaactcattctttatgatgtcagtaatcggccccaggggtttcctgatcgcttctatggctccaagtctgtccctacncggcctccctgaccatcctccggctccngcctgaggacgagctgattattattgttagttacagtataccaacctagtagaactacgtttgggtagtttcgggacggacggggtaaccagggccttacggacccgttaccggtaacgggttcccgaacggtaccccgaaagggtcccttccggccccccgttccgggttaccctaacccgtttccgtcgtttccccccggaccccctttccccgg

SEQ ID NO: 274690 - DNA, 984 bp, Homo sapiens
  misc_feature: GYAE6OF02F3TCD.27.23.C01.1.454.CMB.1.raw
tcagagcgtcgtctcacgaccggtgctcgatttagtacacgtgattagggattggggggggtctcaggaggcaggcgccttctccgggacggtctcccaaccgacttcggcccttggggctcttgctattcctcaccctcctcactcgaggcaccagggtccgtagggtcccgagttctagcccttggtaccttcgtaggcccttgttccgtaccggttggtcctggggttcctccgtgggtacagtcgattcgaccgagttccgggtcctgtcgacctcgggaaccccgtcggggactggacgttggtcgcctttagtaactttctcgtcgttcggtaccgactacggaccctaggcactcgtcccgaactcacttcgtttactgtatcgtacaggtaacgtccgtccccggtaggggtttcgtcggtactaccgtcgttacgtacgtacggtactaccgtaaagttccgtaacggtacccgttaaccgtaaccgggttcccgttacccgttaccggtacccgttacggttcccgggtacccggggggtaccttacccgtaccggtacccgttacgggttaaccgggaaccggtacgggtaccgtaacggttaaacgtttaacgtttaaacgttttacggttaaacggtttttacgtaaactttaaccgttaaccgtaaaaccgtaacgggttaacggtaaacccgttacgggttttaccgggggttacgggttttaacccgggggaacccgggggtaaacgggggtaaccccgtaacggggttacccgtttaacggggtttacccccggttttacccggtttaccggggttacccggaaccggggttacccccggttaaacgggggtccccgtttaccccgggttaacccccccggtttaaccggggttaccccggttaacccgggtttaccccggtttaccccgggttttacccccccgttacccccggtttaacccccgg

SEQ ID NO: 274691 - DNA, 542 bp, Homo sapiens
  misc_feature: GYAE6OF02FWUT6.27.23.C01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtaccgacaggacccaggcactgtccccaaactcattcttatgatgtcagtaatcggccccagggttctgatcgcttcatggctcaagtctgcctacacggcctcctgaccatcctccgggctccacgcctgacggacgaggctgattattattgttagttcatatacaacctagtcgactacgttgggtcgttcgggcgggagggaccaggctcgaccgtctaggtcacgacccaaggtcctcgcccctcggtccaccgttcctcgttccccacctcccg

SEQ ID NO: 274692 - DNA, 591 bp, Homo sapiens
  misc_feature: GYAE6OF02IBG32.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatgacgttggngcttataactttntctgttgtaccgacaggaccaggcactcgtaccccaaactctattctttatgtatgtacagtaatccggccccgtagggtttctgatcgtcttctagtgtctacaagtctcgcctacgaccggtcctccctgaccctacgtccgtccgggctccgacgtccgtaggacggacggaggtcgtagtacttagttattcgttagttactaatactaactaacctagtcgaactacgttgggtgttcgggacggacgggtacgaggtcgtgaccgtcgtaggtcgtacgaccgaggcctaccgcccgtcggtactaccgtcgtccgttcccgtccctccg

SEQ ID NO: 274693 - DNA, 669 bp, Homo sapiens
  misc_feature: GYAE6OF02JA2Y8.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataacttttatctgttggtaccgacaggacccaggcactgtaccccaaactcatttcttatgatgtcagtaatccggcccctagggtttctgactcgcttctatggcctcaagtctgcctacacggcctcctgaccatccgtcggctccgacgtcctggacggtacggaggtccttagtaacttttagttacgtttagttagtttacaagttaactaaacctaaccgtaggttacgtacgttacggtttggggttacggtttccggggagggttaaccgggaccgtacgggaccgttacgggtacccggttccgttagggtacccgaacggttaccccggaacggggtcccttaccggtcccccccgttaacggttccctaccctttccggttacccgtttacccccccacccgtttaccccg

SEQ ID NO: 274694 - DNA, 555 bp, Homo sapiens
  misc_feature: GYAE6OF02GT0V6.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactcgtccccaaactcattctttatgatgtcagtaatcggcccctagggtttctgatcgcttctatggctccaagtctgcctacacggcctccctgaccatccgtccggctccagcctgaggacgagctgtattattattgttagttcatatacaaccagtgactacgttggtgttcggcggacggacaggtctacgaccgtccgtaggtcgacgcccgaaggtcctaccgtccccgtcggtcctaccgttcctccgttccccgtccctcccg

SEQ ID NO: 274695 - DNA, 718 bp, Homo sapiens
  misc_feature: GYAE6OF02J2AC4.27.23.C01.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (505)..(505): a, c, t, g, unknown or other
  misc_feature (505)..(505): n is a, c, g, or t
tcagagcgtcgtctcacgaccggtgctcgatttagtacacgtgattagggattgggggggtcgtcgaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaacccngatgacgttgngcttataactttatctgttggtaccgacacggaccaggcactgtcccaaactcattcttatgtatgtacagtaatccggacccccgtaggggtttctcgtatcgccttcttactggtcctaccaagttctcgtacctacgaccggtcctaccctcgacccagtccgtcccgggcctcccgactcccgtaggaacgggaccgtaggaccttagtaacgtttatttaacgttagttacgtttactaagttaactaacctaaacccgnggtttaaccgacgtttaaccgttgggggtttacgtttaccgggggtacgggtaacggggtaacccgtagggtaccgtacgggttaacccggttccggtaacggtttacccgaacggtaccccgtaaagggtccccgtttaccggcccccccgttaccgggtttaccaaccccggttcccgtttacggttaccccccccgtaacccgttccccg

SEQ ID NO: 274696 - DNA, 568 bp, Homo sapiens
  misc_feature: GYAE6OF02I8UOQ.27.23.C01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtacacgtgattagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattcttatgatgtcagtaatcggccccaggggtttctgatcgcttctatggctccaagtctgcctacacggtcctcctgaccatccgtccgggctccgacgcctgacggacgaggctagtattactattgtagttacatataacaaccagtcgactacgttgggtcgttcgggacggagggaccgaggtctcggtaccgtcgtaggtcacggacccgaaggtcctccgtcccccgttcggtacctaccgttcgtccggttccccgcccttcccg

SEQ ID NO: 274697 - DNA, 734 bp, Homo sapiens
  misc_feature: GYAE6OF02I4YIW.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccccgcgatgacgttggtgcttataactttatctgttggtaccgacaggacccaggcactcgtaccccaactcattctttatgtatgtcagtaactccggcccctaggggtttctgatcgtcttctatcggtctccaagttcctcgcctacgaccggtcccttcccgtcgacctactccgtccgggccttcccgacgtcctggacgggacgacggtctagtatttaagtttagtttgttaacgtttctaattaacttaaccaaaccgtaggttacgaaccttaccggttttggggttcgttttaccggggaccggggtaacggggtaacccgtacggggtaccgttacgggtaaccccggtttacccgtttaacggggtacccgtaaccgggtaccccggtaaacggggtccccgttacccggtaccccccccggtttaccgggtttaccctaaccccggtttcccggtttaccccggttttcccccccgtaaacccccgtttcccccgg

SEQ ID NO: 274698 - DNA, 564 bp, Homo sapiens
  misc_feature: GYAE6OF02FPBY5.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatccggcccccaggggtttctgatcgtcttctatggctccaagtctgcctacgacggcctccctgaccatccgtccgggctccgagcctgacggacgaggctagtattattattgttagttcatactaacaactagtcgactacgttgggtgttcgggcggtagggacaggcgtgaccgtcgtaggtcacggcccgaaggcctccgccccgttcggtcctaccgtccgtccgttccccgccctacccg

SEQ ID NO: 274699 - DNA, 547 bp, Homo sapiens
  misc_feature: GYAE6OF02GAUAL.27.23.C01.1.454.CMB.1.raw
  modified_base (540)..(540): a, c, t, g, unknown or other
  misc_feature (540)..(540): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatccggccccagggtttctgatcgcttctatggctccaagtctgcctacacggcctccctgaccactccgtccgggctcccgacgtcccgtgacgggacgaggtctagtattattattgttagttcattatacaacagtcgactagttgggtgttcggcgggagggacaggctcgaccgtcgtaggcacgccgaaggctcgccccgtcgccactctcgttcccnccctccg

SEQ ID NO: 274700 - DNA, 537 bp, Homo sapiens
  misc_feature: GYAE6OF02FLDAU.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccccgngatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagccctgacggacgaggctgattattattgtagttcatatacaaccagtcgacacgttgggtgttcggcggtagggaccaggctgaccgtctaggtcgagcccaaggcctgcccctggtcacgtctcgttcccgccctcccg

SEQ ID NO: 274701 - DNA, 569 bp, Homo sapiens
  misc_feature: GYAE6OF02GOFBJ.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtacgacacggacccaggcactcgtccccaaactctattctttatgatgtcagtaatccggccccgtaggggtttctgtactcgtcttctatgctccagtctgcctacacgcctcctgaccatccgtccggctccagtcctgacgcgagctgtattattattgtagttcatatacaactagtcgactacgttgggtgttcgggacgggtaggaccgaggtctacgtaccgtcgtaggtccgacggtcccaagggtccgtaccggcccccgtcggtcctaccttccgtccgttccccgcccttcccg

SEQ ID NO: 274702 - DNA, 642 bp, Homo sapiens
  misc_feature: GYAE6OF02I33MX.27.23.C01.1.454.CMB.1.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttgngcttataactttatctgttgtaccgacaggacccaggcactgtccccaaactcattctttatgatgtcagtaatccggccccctaggggtttcctgatcgcttctatggactcaagtctcgcctacacggtcctcctgaccatccgtccgggctccgacgccgtgacggacgaggtcctgtatttacttattgttaacgttctatactaactaaccagtacgactaccggtttggggtacgtttcgggacgggtaaggggacccgtacgggtacgtcggaaccccggttccgtacgggttacccgaacggtacccgaaacggggtccctcccgggttacccccttccggggttcctaacccgtttcccggtcccgttttccccccggcccccgtttccccg

SEQ ID NO: 274703 - DNA, 584 bp, Homo sapiens
  misc_feature: GYAE6OF02I659O.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataacttttatctgttggtaccgacaggacccaggcactgtccccaaactcattctttatgatgtcagtaatcggcccctaggggtttctgatcgcttctatggctccgaagtctgcctacacggcctcctgaccatcctccgggctccagcctgacgagagctgattattattgtagttcatatacaaccagtgactacttgggtcgtttcggacggagggaccaggtcgtacgacccgttcgtacgggtccgaacggtccccgaaagggcccgttacggcccccccgttcgggttacctaacgtttccgtcccggttttcccccgcccgtttccccg

SEQ ID NO: 274704 - DNA, 647 bp, Homo sapiens
  misc_feature: GYAE6OF02HJQMP.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatcttgttggtaccgacacggaccaggcactcgtaccccaaactctattctttatgtatgtctagtaactccggccccgtagggtttctgactcgtcttctagtcggtctaccgaagtctcgaccctacgaccggtccctacccgtcgaccgtactccgtccgggtcctccgacgtccgtaggacggacgaggctagtacttattagttgttagttctattactacaactacgtagtacgtagttcgggtgtaccgggacgggtacgggaccggaggtaccgtcggacccgttacggttacggtccgaacggacccggtaacgggtcccgtaccggtcccccggttcggttaccctaccgttcccgttcccggttcccccgtacccttcccgg

SEQ ID NO: 274705 - DNA, 538 bp, Homo sapiens
  misc_feature: GYAE6OF02JHXBP.27.23.C01.1.454.CMB.1.raw
  modified_base (471)..(471): a, c, t, g, unknown or other
  misc_feature (471)..(471): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccctaggggtttctgatcgcttctatggctccagtctgcctacacggcctcctgaccatctccgggctccagcctgaggacgaggctgactttatattgtagttcagttactacaaccagtgacactttgggtgttcggcggaggaccnggctgaccgtcgtaggtcacgccaaggccgtcgccccgtcggtcacctcgtcgttcccaccctcccg

SEQ ID NO: 274706 - DNA, 595 bp, Homo sapiens
  misc_feature: GYAE6OF02GCN4Y.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgcttataactttatctgttggtaccgacaggacccaggcactgtccccaaactcattctttatgatgtcagtaatccggcccctaggggtttctgatcgcttctatgctcaagtctgcctacaccggtcctccctgacccatccgtccgggcctccgacgcctaggacggacgaggctgtatttattattgttagttctatataacaacctagtgacgtacgtttgggtcggttcgggcgggtacgggaccgaggtcgtcggacccgtccgtacggtcgacggcccgaacgggtcctccggcccccgttcgggtcctaccgttccgttcccgtttacccctacccgttcccg

SEQ ID NO: 274707 - DNA, 552 bp, Homo sapiens
  misc_feature: GYAE6OF02HVWIA.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (413)..(413): a, c, t, g, unknown or other
  misc_feature (413)..(413): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttataactttatctgttggtaccgacaggacccaggcactgtccccaaactcatttctttatgatgtcagtaatccggccccctaggggtttctgatcgcttctatggctccaagtctgccctacacggcctccctgacctactcctccgggctccagcctgaggacgnggctgatttattattgtagttcattataacaacctagtgacgtacgttgggtgttcgggcgggaggaccgaggctcgaccgtcctaggtcacggcccaaggcctcgcccctggcctaccgtctccgttcccaccctccg

SEQ ID NO: 274708 - DNA, 601 bp, Homo sapiens
  misc_feature: GYAE6OF02H3ZH0.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatggacgttggtgcttataactttatctgttggtaccgacacggaccaggcactcgtccccaaactcattctttatgtatgtcagtaatccggccccgtagggtttctgatcgcttctatcggctccagtctgcctacgaccgcctcccgtacgaccactccgtcccgggcctccgacgtccgtacggacggacgaggctagtatttattagtttgtaagtttcaattactacaactagtacgaactacgttgggtacgttcgggacgggacgggaccgaggctcgacccgttcgtacggtccgaggacccgagggtccttccggcccccgttcggtccaccgttccgttccgttccccgcccttcccg

SEQ ID NO: 274709 - DNA, 760 bp, Homo sapiens
  misc_feature: GYAE6OF02I0393.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaacccgngatgacgttggngcttataacttatctgttgtaccgacaggaccaggcactcgtaccccaaactctattctttatgtatgtcagtaacgtccggccccgtaggggtttctgtactcgtcttctatcggcctaccgaagttctcgcctacgacggtccctccctacgacctacgtccgtacccgggtcctaccgacgtccgtacggacggtaccggtacggtcgttacggttaacttttaacgtttagtttacggttaacgtttacctaacgtttaaaccgttaaacccgtaaaccgtaacggttacggtaaaccgtttaccggtttcgggggtttaccggtttccggggacggggtaacggggacccgtacgggtccgtaccggttacccggttaccgttaacgggtacccgtaaccgggtaaccccgtaacgggttaccccgttccccggtaccccccggtttaccgggttacccgtaaccccggtttcccggtttcccggtttaccccccggtcccccgtttaccccgg

SEQ ID NO: 274710 - DNA, 562 bp, Homo sapiens
  misc_feature: GYAE6OF02FTH65.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcatttcttatgatgtcagtaatcggcccccaggggtttctgatcgcttctatggctcaagtctgcctacacggcctccctgaccactcctccgggctcccagcctgacggacgaggctgattattattgttagttctatatacaacagtgactacgttgggtgttcgggcggacgggaccgaggctggaccgtcgtacggtcgacggacccaagggccgtccgcccccgttcggtcctaccgttccgtccgttccccaccctcccg

SEQ ID NO: 274711 - DNA, 563 bp, Homo sapiens
  misc_feature: GYAE6OF02HAWJ0.27.23.C01.1.454.CMB.1.raw
  modified_base (229)..(229): a, c, t, g, unknown or other
  misc_feature (229)..(229): n is a, c, g, or t
  modified_base (426)..(426): a, c, t, g, unknown or other
  misc_feature (426)..(426): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttatctgttggtaccgacaggaccccaggcactgtccccaaactcattctttatgatgtcagtaactccggcccctaggggtttctgatcgcttctatggctcaagtctgcctacacggcctccctgaccatcctccgggctccgacgcctgacggacgaggctgtatttattnttgttagttcaattataacaacctagtagactacgttgggtgttcgggcggacgggaccgaggctgaccgttcgtaggtcacgcccgaaggctccgccccgtcggtcctaccgttcctccgttccccacccttcccg

SEQ ID NO: 274712 - DNA, 651 bp, Homo sapiens
  misc_feature: GYAE6OF02GXMEM.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggncttataactttntctgttggtaccgacaggaccaggcactcgtaccccaaactctattctttatgtatgtacgtagtaacgtccggacccccgtaggggtttctgtactcgtcttctagtcggctaccaagtctgcctacgaccggtcctcccgtcgaccctactccgtaccgggctacccgacgtccgtagacgggacgacggtctacgtaattagtttagttgttagttactaattactaacctaacgtacgtgtaacctacggtttggggtcgttacgggaccggggtacggaccgtacgggtcttacggacccgttccgtacgggttccaaccggaacccgtacggccgttaccggcccccgttcgggtacctaccgttcccgtccggttccccgcccttacccg

SEQ ID NO: 274713 - DNA, 541 bp, Homo sapiens
  misc_feature: GYAE6OF02HX229.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttaataacttttatcttgttggtaccgacaggacccaggcactcgtccccaaactcattctttatgatgtcagtaatccggccccaggggtttctgatcgcttctatggctcaagtctgcctacacggcctccctgaccatccgtcccgggctccgacgcctggacggacgaggctgattattattgtagttcatatacaacagtgactagttgggtgttcggcggagggaccaggctgaccgtcgtaggtcagccgaacggctcgccccgtcggtccactcgtcgttcccgcctcc

SEQ ID NO: 274714 - DNA, 637 bp, Homo sapiens
  misc_feature: GYAE6OF02IXWIR.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctcctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaacccncgatggacgttggtgcttataactttatctgttggtaccgacacggacccaggcactcgtacccccaaactcctatttcttttatgtacttcgtccaagtaactcccgggcccctaggggtttctgtatcgctttcagtcggctaccaagttctcgccctacgaccggtccctcctcgacctactccgtcccgggctcccgacgtcctggacggacggtggctagtaatttattagtttagttacgttactattaactaaccgaactagtagaccgtacgttgggtcgttcgggcggtacgggccacggtctacggtaccgtccgttacggccacggacccaacgggtcctcccggacccccgttcggtccctaccgttccgtacccgtttccccacccgttcccg

SEQ ID NO: 274715 - DNA, 643 bp, Homo sapiens
  misc_feature: GYAE6OF02ITWAW.27.23.C01.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactggaaccccgngatgacgttggngcttataactttatctgttggtaccgacaggacccaggcactcgtcccccaaactcatttctttatgatgtcaagtaatccggcccctaggggtttctgattcgcttcatggctccaagtccngcctacacggcctcctgaccacttccgtcccgggctccgacgtccctaggacgggaccgaggtctaggtactttattacgtttggttattactattaactaactaacctaggttagaccgtacggtttggggtcggtttcgggacgggtacggggtaaccaggtccgtcggtacccggttccgtaacgggtcccgaaggtaccccgaagggtccctcggtccccccgttcggtaccctaccgttccgtacccgttaccccctaccccgttaccccg

SEQ ID NO: 274716 - DNA, 599 bp, Homo sapiens
  misc_feature: GYAE6OF02GH7DK.27.23.C01.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
tcagagcgtcgtctcacgaccggtgctcgatttagtacacgtgattagggagttgggggggtctcaggaggcagcgctctcgggacgtctccaccatggcctgggctctgtctattcctcaccctctcactcagggtcacagggtcctgggcccaggtctggccctgactcagcctgacctccgtgtctgggtctcctggacngtcgatcaccatcctcctgcactggaacccgngatgacgttggncttatacttntctgtggtaccgacaggacccaggcactcgtccccaaactcattctttatgatgtcagtaatccggcccctagggtttcngatcgcttctatggctcagtctgcctacncgcctcctgaccatccgtccgggctccacgccgtgacggacgaggtcctagtactttattagttgttaacgtttctaattaactaaccgaacctaggttcgaactacgtttgggttcgttccgggcgggacgggtaccaggcgtcgtaccgtcgtacggtccgacggtacccgaacggtcctccggtcccccgtcggtacctaccgttccgtccggttccccgcccttacccg

SEQ ID NO: 274717 - DNA, 640 bp, Homo sapiens
  misc_feature: GYAE6OF02JBHL3.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatcttgttggtaccgacaggacccaggcactcgtacccccaaactctattctttatgtatgtacaagtaacgtccggcccccgtaggggtttctgtactcgtcttctagtcggtcctacctaagtcctcgccctacgaccggtccctccctcgaccctatccgtcccggcctaccgacgccgtaggacggacggaggtctagtatttaattagttgttagttacaattactaaccaactagtcaacgttacggttgggtcgttcgggacgggtacgggaccgaggtctacggtacccgttcgtaggtccgaacggtacccgaaggtcccgttccgaccccccgttcggtacctaccttccgtcccgttcccccgtccttaccccg

SEQ ID NO: 274718 - DNA, 649 bp, Homo sapiens
  misc_feature: GYAE6OF02I0BGC.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (329)..(329): a, c, t, g, unknown or other
  misc_feature (329)..(329): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggngctttaataactttntcttgttggtaccgacacggacccaggcactcgtaccccaaactctaatttctttaatgtatgtcagtaacnccggtccccgtaggggtttctggacttcgtcttcgtatcggtcctaccgaagttcctcggtaccctacgtaccggtccctcccttacggaccctaacgttccgtcccgggtcctcccgaacgtcctacggacggaccgaggtctaggtactttattacgttagttacgtttacaagttactaaccaactacgtagacgtacgttgggttaggttccgggacgggtagggacctgggctacggacccgtcgtaggtccgaacggtaccgacggtcctcccgaccccgtgtccaccttccgtccgttaccccacccgtcccg

SEQ ID NO: 274719 - DNA, 595 bp, Homo sapiens
  misc_feature: GYAE6OF02IPWFI.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (338)..(338): a, c, t, g, unknown or other
  misc_feature (338)..(338): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttataactttatctgttggtaccgacaggacccaggcactgtaccccaaactcaattctttatgatgtcagtaatccggcccctaggggtttcngtatcgcttctatggctaccaagtctcgcctacacggtcctccctgacctatccgtccgggctcccgacgtcctggacggacgaggctagattattattgttagttacataatacaaaccagttacgactacgttgggtgttacgggcggtacgggacgtaggcgtcgaccggtcctaacgggtcaacggccccgaagggtcctaccgtcccccgtcggttccctaccgttccttcgttcccccgtccccttacccg

SEQ ID NO: 274720 - DNA, 735 bp, Homo sapiens
  misc_feature: GYAE6OF02G4Q8W.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatcttgttggtaccgacacggacccaggcactcgtccccaaactcattctttatgatgtcagtactccggccccgtagggtttctgtactcgtcttctagtcggtcctaccaagttctacgtaccctacgaccgggtccccttcccgtacgaccctacgttccgtcccgggtcctacccgacgtcccgtgggaacggaccggtaacggtcgttacgtaagttttaagtttagtttcggttaacggtttactaacttaactaacctaaaccgtaggttacgtaacgtaccggtttggggttacggtttaccggggacggggtacgggaacccggtacgggtaccgtacgggtaacccggttaccgttaacgggtaccgtaaccgggtaccccgaaacgggtcccgttacccggtccccccgttacgggttaccctacccgttcccggttacccggtttaccccccggtcccccgttaccccg

SEQ ID NO: 274721 - DNA, 710 bp, Homo sapiens
  misc_feature: GYAE6OF02HI31D.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtaccccaactctatttcttatgatgtcagtaactccggccccgtagggtttctgatcgtcttctagtcggcctccaagttctcgtaccctacgaccggtccctccctcgaccctacgtccgtcccgggtcctacccgacgtcccgtagggacgggaccggacggtctaggtaattttattagttgttacgtttactaagtaactaacctaaccgtagtacgtaaccgtacggtttggggttcggtttaccgggacggggtaacgggtaacccgacgggtaccgttacgggtaacccggttccgttaacgggtacccgaaccgggtaccccgtaaacggggtcccgttaccccgggtaccccccgttacgggttaccctacccgtttcccgtttacccggtttaccccccaccccgtttaccccg

SEQ ID NO: 274722 - DNA, 544 bp, Homo sapiens
  misc_feature: GYAE6OF02F2E9W.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatcctccgggctccagccctgaggacgaggctgattattattgtagttcatatacaaccagtcgacacgttgggtgtttcgggcggagggaccaggctcggaccgtctaggtcaacggcccgaaggcctcgccccctggtccacctcgtcgttccccaccctccc

SEQ ID NO: 274723 - DNA, 567 bp, Homo sapiens
  misc_feature: GYAE6OF02IH8YH.27.23.C01.1.454.CMB.1.raw
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccctaggggtttctgatcgcttctatggctcaagtctgcctacacggcctcctgaccactctccgggctccagcctgacggtacgaggctagacttatattgtagttcatactactaaccagtacgactacgttgggtgttcgggcggagggaccgaggctgaaccgtccgtaaggtcacggcccaagggtcctacggcccccgttcgggtccctaccgtccgtcgtttacccccgcccgttccccg

SEQ ID NO: 274724 - DNA, 624 bp, Homo sapiens
  misc_feature: GYAE6OF02JR8HP.27.23.C01.1.454.CMB.1.raw
  modified_base (250)..(250): a, c, t, g, unknown or other
  misc_feature (250)..(250): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctggggtctcctggacagtcgatcaccatctcctgcactgggaacccgacgtatgtacgttggtgtnttaattaactttattctgttacggtaccgacgacggaccgacgacactcctaccctaacctactattactttatagtatgtacgtaacgtaacgtaccggtacccggtacgggttcgtcgtacgtcgtcttctatcgtctactacgtactcgtctacgaccgtcctcctacgtactactccgtccgtccgtaccacgacgtcggacggacggacgtacgtagtattattattagttagttactataactaacaactagtagtacgtacgtggttcggtcggtacggacggacgacgtacgtcgtacgtacgtacgtacgaccgaccgacgtacgtccgtcccgtccgtaccgtacctccgtccgtcccgtcccg

SEQ ID NO: 274725 - DNA, 618 bp, Homo sapiens
  misc_feature: GYAE6OF02JP4X8.27.23.C01.1.454.CMB.1.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
tcagagcgtcgtctcacgaccggtgctcgatttagtacacgtgattagggagttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggngcttataactttntctgttgtacgacaggaccaggcactgtcccaaactctattcgtttatgtatgtcagtaactcggccccgtagggttctggatcgtctctatcggtctaccagtctgtcctacacggtcccctcctcgaccctacgtccgtcccgggtctcctacgcctggaacggacgacggctaggtatttattacttgttacgtttaccagttaactacaaccgtagttcgaactacgttgggtcgttcgggacgggtacgggaccgtaggaccgttggacccgttcgtaaggtcctaacggcccgtaaggtccgtccggtccccgtacggtcctaccgtccgttaccgtttcccgaccccgttcccg

SEQ ID NO: 274726 - DNA, 613 bp, Homo sapiens
  misc_feature: GYAE6OF02JE4BG.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtnctttataacttttatctgttggtaccgacaggacccaggccactcgtccccaaactctattcttatgtatgtcagtaactccggcccctagggtttctgactcgcttctagtgctcagtctgcctacacggtcctccctgacctacgtccgtccgggctcccgacgcctggacggacgaggtctagtaatttagttattaggttagttcattaactaaccaacctaggtcgaccgtacgtttcggggtacgttcgggacgggacgggtaccgaggtcctcggtacccgtccgtacggtccacggacccgaagggtccctccggtacccccttcggtcctaccgttcgtcccgttccccgccccttcccg

SEQ ID NO: 274727 - DNA, 734 bp, Homo sapiens
  misc_feature: GYAE6OF02I2OW6.27.23.C01.1.454.CMB.1.raw
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagttcgatcaccatctcctgcactcggaaccccgngatgacgttggntcttataactttntcgttgttaggtaccgacgacggaccaggcactcgtaccccaaactctactttctttatgtatgtactaagtaactccggaccccgttagggtttctgtactcgtcttacttagtcggtccttacctaacgttccgtacgtacccgttaacgaccggtcccttacccgtacgaccctacgttccggttcccgggtacccttaccgaccgtccgtaagggaccgggtaacggacggttcgtagttaactttaactttacgttggttaacggtttactaattaaaccttaaacaaccgttaggtcgtaaccgtttacgggtttggggtacgtttaccggggacggggtaacgtaaccggtaggtaccgtacgtacccgttaccgtagggtaccgaccggtaaccccgaggtcccgtcccggttcccccgtacggtacccgtacctttccgtaccccggttaccccctacccgtacccg

SEQ ID NO: 274728 - DNA, 634 bp, Homo sapiens
  misc_feature: GYAE6OF02GMM9E.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtncttaataactttatctgttggtaccgacaggacccaggcactcgtaccccaaactctattctttatgtatgtcagtaacgtccggccccgtagggtttctgtactcgtcttctagtcggtacctccgtaagtctcgtccttacgaccggtccctaccctcgaaccctacttccgtccgggtcctccgaacgtcccgtaggaagggaccgaggtctacgtaatttagttgtttagttacgttctaattactaacgaacctaggtcgtaaccgtacgtttgggttacggttcgggacgggtacgggtaccaggtccgtacgacccgttcgtagggtccaacggacccgaggtcctccgccccgttcgtcaccttcgtaccgttcccaccctccg

SEQ ID NO: 274729 - DNA, 667 bp, Homo sapiens
  misc_feature: GYAE6OF02HOFEB.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtaccccaaactctacttctttatgatgtctagtaacgtccggccccgtaggggttctgactcgtcttctatcgtctcaagtctcgcctacaccggtcctcccgtcgacctatccgtcccgggcctccgacgtccgtggacggacggacggcttaggtaatttagtttagtttggttaagtttacaattaactaactaaccgtacggttacgaaccgttacggtttcggggtacggtttacggggacggtaacggggtacccgacggtcgttacggacccggttcccgtaacgggttaccgacggtaccccgaagggtcccgtacccggtcccccgttcgggtcctaccgttcccgttacccggttccccgtcccttccccg

SEQ ID NO: 274730 - DNA, 562 bp, Homo sapiens
  misc_feature: GYAE6OF02F5PCP.27.23.C01.1.454.CMB.1.raw
  modified_base (370)..(370): a, c, t, g, unknown or other
  misc_feature (370)..(370): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaactccggcccctaggggtttctgatcgtcttctatggctccaagtctgcctacncggcctcctgaccatctccgggctccagcctgacggacgaggctagtattattattgtagttctatatacaacagtgactacgttgggtcgttcggcggaggaccaggcgtcgaccgtcgtaggtccgaacggacccgaaggctccggtcccccgtcggtcctaccgttccgtccgttccccgcccttcccg

SEQ ID NO: 274731 - DNA, 600 bp, Homo sapiens
  misc_feature: GYAE6OF02GZDVQ.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataacttttatcttgttggtaccgacaggacccaggcactcgtccccaaatcattctttatgatgtctagtaatcggcccctagggttctgatcgcttctatgctcaagtctcgcctacacggcctccctgacctactccgtccgggctccgacgtccctggacggacggacggtctagtacttattatttgttaagtttctaattaactaaccaaaccgtagtcgaactacgttgggttgttcgggacgggagggtaccgaggcgtcgaccgttcgtacggtcgacggtacccgaaggtcctccggaccccgttccggtccaccgttccgttccggttccccgtccctacccg

SEQ ID NO: 274732 - DNA, 728 bp, Homo sapiens
  misc_feature: GYAE6OF02JP18B.27.23.C01.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccncgatgacgttgggncttataactttatctgttgtacgacagaccacggcactcgtacccaactctacttcttatgtatcgtctagtaactcggccccgtagggtttctgtacttcgtccgttacttacgtcggtcctaccgtaagtccttcggtaccctaccgaccggtcccctacccgtacggaccctaacgttccggttcccgggtacctacccgtacggtacccgttcggtaaccggggtaaccggacgggtaccgtagggttacttttaagtttaccgtttaggttaacggttttacctaactttaactaaccgtaaaccgtacggttacgaaccgttaacggtttcggggtcgttaccgggacgggttacgggaaccgtcgggtacgtcgaccggttaccgtacggtacgaccggtaccgacgggtaccgtaccgtcccccgtacgggttaccctaccgttccgttacccggttccccgaccccttacccgg

SEQ ID NO: 274733 - DNA, 565 bp, Homo sapiens
  misc_feature: GYAE6OF02GICQP.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgcttataactttatctgttggtaccgacaggacccaggcactgtccccaaactcattctttatgatgtcagtaatcggccccagggtttctgatcgcttctatggtctccaagtctgccctacacggcctccctgacccatcctccgggctccacgcctgaggacgaggctgatttattattgttagttctatataacaaccagtcacgacgttgggtgttcgggcgggtagggaccgaggctgaccgtccgtacggtcgacgcccaaagggcctccgtcccccgcggttccaccgttccgtccgtttccccgcccttcccg

SEQ ID NO: 274734 - DNA, 660 bp, Homo sapiens
  misc_feature: GYAE6OF02GO7HO.27.23.C01.1.454.CMB.1.raw
  modified_base (554)..(554): a, c, t, g, unknown or other
  misc_feature (554)..(554): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgtcttaataactttatcttgttcggtaccgacgacggacccaggcactcgtaccccaaactctatttctttatgtatgtactagtactccggccccgtagggtttctagactcgtcttctacgtcggtcctaccgtaagtctacgtaccctaccgaccggtcccctccctacgacccacgttccgtcccgggtctcccgacgtccgtaggacgggacgaggtctagtatttacgttagttagttacgttactattactaactaaccgtagtactacgtacggttgggttcgttcgggacggacgggtaccncggtccgtacgacccgttcgacggtccgacggacccgtaacggtccgttacccggccccggttcggtacccttaccgttccgttccgttacccccacccgttcccg

SEQ ID NO: 274735 - DNA, 675 bp, Homo sapiens
  misc_feature: GYAE6OF02HQMJ1.27.23.C01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
tcagagcgtcgtctcacgaccggtgctcgatttagtacacgtgattagggagttggggggggtctcacggaggcagcgctctcgggacgtctccaccgatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggncttaataactttatctgttggtaccgacacggaccaggcactcgtaccccaaatcattcttatgatgtactagtaactccggccccgtagggttctgactcgtcttctagtcggctaccgtaagtcctcgtaccctacgaccggtccctcccgtacgacctacttccgtcccgggacctaccgacgtccgttaggaacgggacggaggtctagttactttaagttattggttaagttacaagttaactaacctaaaccgtagttcgaaccttacggtttaggggtcggttccggggacgggtaacgggacccgtaggtccgtacggtacccggttacgtaacggtaccgacggtacccggaaggtcccgttcccgtaccccccggttcgtacccgtccttccggttcccgttcccccgtccccttacccg

SEQ ID NO: 274736 - DNA, 782 bp, Homo sapiens
  misc_feature: GYAE6OF02I29ZH.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatctcctgcacgtcggaacccgngatggtacgttggtgtactttaataactttatcttggttcggtaaccgacacggacccaggccactcgtaccccaactctatttcttatgatgtacagtaacgtcccggtaccccgtagggtttctgtactcgtcttctagtcggcctaccgtaagtcctcgaccctaccgaccggtcccctccctacgtaaccctacgttcccggtacccgggtccttacccgacggtacccgtagggaccgggtaaccggtaggtccgtttaaggtaacttttaacgtttagttttacggttaagttttaccgtaattaaccgtaaacctaaaccgtaggttacgtaaccgttacgggtttcggggttacgggttaccggggaccggggtaacggggtaaccggtacgggtaccgttaccgggtaacccggttaccggttaacgggtacccgtaaaccggtaccccggtaaaggtccccgttaccccggtcccccggttaccgggttaccctaccgttacccgttccccggtttacccccccgtacccctacccgg

SEQ ID NO: 274737 - DNA, 533 bp, Homo sapiens
  misc_feature: GYAE6OF02JFM8I.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (443)..(443): a, c, t, g, unknown or other
  misc_feature (443)..(443): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccncgatgacgttggngctttataactttntctgttggtaccgacaggacccaggcactgtccccaaactcattctttatgatgtcagtaatcggccccaggggtttctgatcgcttctatggctccaagtctgcctacacggcctccctgaccatctccgggctccagcctgaggtacgaggctgtattattattgttagttcatatacaccagtnacacttgggtcgttcggcggacgggacaggctgaccgtcgtaggtcacgcccaaggcctcgcccctcgtcacctctcgtcccgccctccc

SEQ ID NO: 274738 - DNA, 551 bp, Homo sapiens
  misc_feature: GYAE6OF02FZF06.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttaataactttatctgttggtaccgacaggacccaggcactgtccccaaactcattctttatgatgtcagtaatcggccccgaggggtttctgatcgcttctatggctcaagtctgcctacacggcctccctgacccatcgtcccgggctccagccctgaggacgagctgattagttattgttagttcatataacaacagtgactattgggtgttcgggcggagggaccaggctgaccgtctacggtcgacgacccgaaggtcctccgcccgtcgtcctaccgtcctccgttccccgtccctcccg

SEQ ID NO: 274739 - DNA, 583 bp, Homo sapiens
  misc_feature: GYAE6OF02H20S0.27.23.C01.1.454.CMB.1.raw
  modified_base (452)..(452): a, c, t, g, unknown or other
  misc_feature (452)..(452): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataactttatctgttggtaccgacaggaccaggcactcgtaccccaaactcattctttatgtatgtcagtaactccggccccctaggggttttctgtactcgtcttctagtcggctccaagtctcgacctacgaccggtcctcctcgacctatccgtccgggctccgacgcctggaggacgagctagattattattgttagttanatactacacagtcgactacgttgggtgttcgggcggacgggcgaggccgtagacccgtcgtaggtccgacggaccgacggcctccggccccgttcggtcctaccgttccgtcgttcccccggccttacccg

SEQ ID NO: 274740 - DNA, 796 bp, Homo sapiens
  misc_feature: GYAE6OF02I7UKS.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccgatctcctgcactggaacccgngatggacgttggtgaccttagtaacctttatctgttcggtaccgacaggacccaggcactcgtaccccaaactcatttcttatgatgtcagtactccggcccctagggttctgactcgcttctagtcggctcgaagtctcgaccctacgaccggtcctcccgtcgaccctacgttcccgtcccgggtcctacccgtacgtacccgtagggaacgggaacggtaaccgggtccgttaggttaaacgttttaagtttaacgtttacgggtttaacgttaccgttaaatttaaaccgttaaaccccgtaaaacccggtaaggttaacccggtaaccgttaacccggggtttacggggtttccgggttttaaccggggtaccgggggaaaccggggtaaccccggtaacgggtaaccccgttaccggaaccccggtttaccggtaacgggttacccgaaccggggtaaccccgtaaaccggggtcccttaccccggtaccccccggttaccgggtacccgttacccgtttcccgttccccgggtttccccccgccccgtttaaccccgg

SEQ ID NO: 274741 - DNA, 827 bp, Homo sapiens
  misc_feature: GYAE6OF02HEVRQ.27.23.C01.1.454.CMB.1.raw
  modified_base (318)..(318): a, c, t, g, unknown or other
  misc_feature (318)..(318): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgtcttaataactttatcttggttggtaccgacacggaccccaggcacgtcgtacccccaaactctactttcttangtatcgtacgtaagttaaccgtccccggtaccccggttaggggtttctacgtacgttccggttacctttacgtagttcggtacctaaccgtaagttccgtaccgtaccccgtaaccggacccggtccccttacccgtacgaaccctaccgttcccgggtcccgggtacctacccgacgtcccggtaagggaacgggaaccggtaggtccgttaagttaaacgttttaacgttttaggtttacggttaacgtttacctaaagttaaacctaaacccgtaaaccggtaggttaaccggtaaccgttttaccggggtttgggggtttaccgggttaccgggggaaccggggtaaaccggggtaccgtaccgggtacgttacccgggttacccgtaccgggttacgggtacccgaccgggtaccccgtaagggtcccgttacccccggtacccccggtttcggtaccttcccggtttcccggtaccccgggtttcccccctaccccgttaccg

SEQ ID NO: 274742 - DNA, 733 bp, Homo sapiens
  misc_feature: GYAE6OF02J14XV.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattgggggggtcgtcgaggaggcagcgctctcgggacgtctccaccatggcctgggctctgctatcctcaccctcctcactcaggcacagggtcctgggcccagtctgccctgactcagcctgcctccgtgtctgggtctccgtggacagtcgatcaccatcctcctgcactcggaacccngatcgacgttggngctttataacctttntctgttcggtaccgacgacgaccaggccaccgtcgtaccccctaaacttcactttacttatgatgtactagtaacgtccgggtaccccgttagggtttactggacctcgtcttcgtatcggtacctaccgaacgttctcgtccctaacgtacccgcccttcccgtacgtaacctcgccgttcccggccttaccgacgtaccgtacgtacgggaccgtaaggcttaacgttagtttacttaggttcgttaagtttaccaagttacctaacacctaagtctaaaccggttcggttcgggttacgtttaccggggaccggtacggtacccggtaacggtccgttacgaacccccggttgttacgggtacccgtaaccggaccccggtaacggttccctacccccgggttaccccgtcccggttaacccgtccgtttaccccggtttccgttaacccccccgttccccgttaacccgg

SEQ ID NO: 274743 - DNA, 546 bp, Homo sapiens
  misc_feature: GYAE6OF02FUUQL.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccngatgacgttggtgcttataactttatctgttggtaccgacaggacccaggcactgtccccaaactcattctttatgatgtcagtaatcggccccatgggtttctgatcgcttctatggctccaagtctgcctacacggcctccctgaccactcgtccgggcctccgacgcctgaggacgaggctagattattattgtagttcatatacaactagtgactacgttgggtgttcgggcggaggacaggcgtacgtaccgtctacggtcaagcccgaaggtcctcgcccctcggttaccactcctcgttcccgtccccg

SEQ ID NO: 274744 - DNA, 695 bp, Homo sapiens
  misc_feature: GYAE6OF02HLJ8M.27.23.C01.1.454.CMB.1.raw
  modified_base (229)..(229): a, c, t, g, unknown or other
  misc_feature (229)..(229): n is a, c, g, or t
  modified_base (388)..(388): a, c, t, g, unknown or other
  misc_feature (388)..(388): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttaggtaccgacacggaccaggcactcgtacccccaaactctattctttatgtatgtcagtaactccggcccccgtaggggtttctgactcgtcttctatcgctccaagttctgcctacacggcctcccngaccagtccgtccgggcctccgacgtccgtaggacggacggacggtctaggtactttaacgtttagtttaggtttacgtttacaacgttaactaaccgtaaacctaaggtacgtaaccgttacggtttcggggttaggtttaccggggacgggtaaccggggtacccgagggtaccgttacggtacccgttccggttaacggtaccgtaccgggacccgtaacgggtcccgttacccggtccccccgttaccggttacccgtaccgtttccccggtttcccggttacccccgttcccccgttacccg

SEQ ID NO: 274745 - DNA, 662 bp, Homo sapiens
  misc_feature: GYAE6OF02JCL9P.27.23.C01.1.454.CMB.1.raw
  modified_base (230)..(230): a, c, t, g, unknown or other
  misc_feature (230)..(230): n is a, c, g, or t
  modified_base (385)..(385): a, c, t, g, unknown or other
  misc_feature (385)..(385): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccncgatgacgttggtgcttataactttatctgttcggtaccgacacggaccaggcactcgtaccccaaactctatttcttatgtatgtacaagtaactccggccccgtagggtttctagactcgtcttacgtatcgctacgaagtcgtcgacctacncggtcctccgtcaccatccgtccgctccgacgtcgtaggacgacggacgtcgtagtatttaattagttgttaacgtttactaattaacgtaactaaacctacggtacgttacgtaacggtttcggggttacggttacgggacgggtaacgggtacccgtaggtaccgtcggtacccggtcgttacgggaccgtacggtacccggtacggtacccgttcccggttaccccgtcggttacccgtaccgttcccgttcccggttccccgtcccgttcccg

SEQ ID NO: 274746 - DNA, 736 bp, Homo sapiens
  misc_feature: GYAE6OF02I7AUQ.27.23.C01.1.454.CMB.1.raw
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtcgtcttaataactttntctgttcggtaccgacacggacccaggcactcgtaccccaaactctatttcttatgtatgtctaagttaacgtccgggtccccgtaggggtttctaggtactccgtctttactagtcggtacctaccgtaacgttcctacgtaccccttaacgacccgggtccccttcccgtacgtaacccgtacgtttcccggtacccggggtccttacccgacggtcccgtagggaacgggtaccggacgggttaccttaggttaagtttatttagtttcggttaacgttactaattaactaacctaaccgtagttacgtaccgttacggtttggggttcgttacggggacgggtaacgggaccgtcggtccgtacgtacccggtccgttacggtaccgaacggtaccccgaagggtcccgtacccggtcccccgttacggttccctacccgttccgttaccccggttcccccgcccgttacccg

SEQ ID NO: 274747 - DNA, 649 bp, Homo sapiens
  misc_feature: GYAE6OF02FZOFO.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttataactttatctgttggtaccgacaggacccaggcactcgtaccccaactcatttctttatgatgtcagtaactccggccccgtaggggtttctgactcgtcttctagtcggtctaccaacgtctcgacctacgaccggcctccctacgacctacgtccgtccgggcctaccgacgtccgtggacgggacggacggtctagtaatttagttagtttcgttaacgttctaacttaactaacctaacgtagtacgtacgtacggttgggttcgggtttaccgggacgggtacggggtaccgaggtcgtaccgaccgttaccgtacggtacgacggacccgtacggtcccgtaccgcccccgttcggtccctaccgttccgtacccgttccccgtacccgtcccg

SEQ ID NO: 274748 - DNA, 820 bp, Homo sapiens
  misc_feature: GYAE6OF02IZSIR.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcacgtggaacccgngatgacgttggtgctttataactttatcttgttggtaccgacacggaccaggcactcgtacccaaatctattctttatgatgtcagtaactccggccccgtaggggtttctaggtacttcggtccttacttagtcggtcctacctaaagttccgtacggtaccctaacgtacccggtcccctcccgtacgtaaccctaacgttcccggtcccgggtcctacccgtaacggtcccgtacgggacgggtaacccggtacggtaccgttaggttaaacttttaaacgttttacgttttacgggttaacgtttaccttaaacgttaacttaaaaccgtaaacccgtaaacgggttacgtaaaccgttaacggtttttacggggggttcgttttaccggggggtaaccgggtaacggggtaacccgtaaacgggtcccgttaccgggtaaccccggtttaccggttaaccgggtttaccgaacccgggtaaccccgtaaacggggtccccgttcccggtacccccccggtttacgggttcccgttaacccgttttcccggttaccccggtttacccccgtaccccccgttaaccg

SEQ ID NO: 274749 - DNA, 727 bp, Homo sapiens
  misc_feature: GYAE6OF02HMLCE.27.23.C01.1.454.CMB.1.raw
  modified_base (252)..(252): a, c, t, g, unknown or other
  misc_feature (252)..(252): n is a, c, g, or t
  modified_base (408)..(408): a, c, t, g, unknown or other
  misc_feature (408)..(408): n is a, c, g, or t
  modified_base (545)..(545): a, c, t, g, unknown or other
  misc_feature (545)..(545): n is a, c, g, or t
  modified_base (615)..(615): a, c, t, g, unknown or other
  misc_feature (615)..(615): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgcccctgactcacgcctcgccctccgtgtcgtcgggtcctccgtggactagtcgactccacctacttcctcctcgaccacgtaccggaacccgngtatcggtacggttggtcgtactttaactttaactttatcgttggttcggtaaccgacgacggacccgaggacctacgtccgtaacccccaaactctattttactttagtagtattcgtacgtaagttaacgtcccggaccccggttagggtttcngtactccgtcttctagtcggtcctaccgtaagtcgtcgtaccctaccgaccggtccccttacccgtcgaccctacgttcccggtcccgggtcctaccgaccgtccgtaggacgggacggacgtctagtatttagttnttgttattcaattactaaccaacgtagtcgaacgttacggttgggtcgttcgggacgggtacgaaccggnggtccgtacgtacccgttacgttacggtacgaccggacccgtaacggtcccgtcccggtcccccgtacggtaccctaccgttccgttccccgttaccccctaccccttcccg

SEQ ID NO: 274750 - DNA, 671 bp, Homo sapiens
  misc_feature: GYAE6OF02GZM1T.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccncgatgacgttggtgtcttataactttatcttgttggtaccgacacggacccaggcactcgtaccccaaactcactttcttatgatcgtcagtactccggccccgtagggttctgactcgtcttctagtcggtctaccgaagttccgtcgtaccctaccgtaccggtccctacccgtacgaccctacgttccgtacccgggtcctacccgacggtcccgtaggaaccgggacgacggtctaggttatttaacgttagttagttagtttacaattaactacctaaactagtgaacttacgttggggttacgttcgggaccgggtacggtaccgtggaccgtacggtacccgttcgtacggtaccgacggtaccgaacggtcctcccggtacccccgttcggttaccctaccgttcccgtttccgttcccccggcccttacccg

SEQ ID NO: 274751 - DNA, 646 bp, Homo sapiens
  misc_feature: GYAE6OF02GKKUW.27.23.C01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaacccngatgacgttggtgcttataactttatctgttggtacgacacggacccaggcactcgtccccaaactctattctttatgatgtcagtaactccggccccgtaggggtttctgactcgtcttctatcggctaccaagtctcgtaccctacgaccggtccctccctacgacctactccgtccgggtctccacgtccgtggaacgggacggaggtctaggtaatttattagtttgttaagttctaagttactaacgtaaccgtagttacgacctacggtttcggggttacggttccgggacgggaacgggtaccgtacggtccgtacggtacccgttcgtacggtccgacgacccgtaacgggtccctaccggtcccccgttacggtcctaccgttccgtccgttacccccacccgtacccg

SEQ ID NO: 274752 - DNA, 570 bp, Homo sapiens
  misc_feature: GYAE6OF02HSD5T.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtacgacaggacccaggcactgtccccaaactcattctttatgatgtcagtaatccggcccctagggttctgatcgcttctatgctccaagtctgcctacacggcctccctcgaccactctccgggcctccagtccctggaggacgaggtctgattacttattgtagttcaattataacacagtgactacgttgggtgttcggcggtagggaccgaggcgtcgaccgttccgtaggtaccaggcccgaacgggcctaccgtcccccgtcggtccctaccgttcccttccgttacccctacccttcccg

SEQ ID NO: 274753 - DNA, 702 bp, Homo sapiens
  misc_feature: GYAE6OF02IA48H.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatgacgttggtcgcttataactttatctgttggtaccgacacggaccaggcactcgtcccaactctattctttatcgtatgtacagtactccggcccccgtaggggtttctgtactcgtcttctatcggctaccgaagtctacgacctacgaccggtccctccctcgaccctactccgtcccgggccttaccgacgtccgtaggacggacggacggttccgtagttaactttagtttaagtttagttaacgttttaccaattaacttaaaccgtaaacccgtaggttaacgtaaccgttaacggtttcggggttacggttccggggacgggtaacggggtacccgtaggtaccgttcggtaacccgttaccggttaacgggtccgaaccggtacccggaacggtccccgttccgcccccgttcggttccctaacccgttcccggttacccgttcccccgcccttacccgg

SEQ ID NO: 274754 - DNA, 637 bp, Homo sapiens
  misc_feature: GYAE6OF02G4274.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaacccgcgatgacgttggtgtcttataacttttatcttgttggtaccgacaggacccaggcactcgtaccccaaactctactttctttatgtatgtctaagtaacgtccggccccgtaggggtttcctgatcgtcttcgtattcggttaccagttctcgcctacgaccgtcctcctcgacctactccgtccgggctccacgtcctggacggacgaggtctagtattattattgtagttctattactaaccaactagtacgactacgttgggttcggttcgggacgggtacgggtaccagggtccgtacggtaccggttccgtacggttccgacggacccgtacggtccctccggtcccccgttaggtccctacgtttcccgttcccggtttccccgtaccccttccgtacccgg

SEQ ID NO: 274755 - DNA, 531 bp, Homo sapiens
  misc_feature: GYAE6OF02GOXFT.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggnctttataactttatctgttgtaccgacaggacccaggcactgtccccaaactcattctttatgatgtcagtaatcggcccctagggtttctgatcgcttctatggctcaagtctgcctacacggcctccctgaccactccgtccggctccagcctgaggacgagctgattattattgttagttcatatacaacagtgactacgttgggtcgttcggcggaggacaggctcgaccgtcgtagtcacgacccaagctcgccccgtggtccactcgtcgttcccgccctccg

SEQ ID NO: 274756 - DNA, 536 bp, Homo sapiens
  misc_feature: GYAE6OF02HXQ0V.27.23.C01.1.454.CMB.1.raw
  modified_base (426)..(426): a, c, t, g, unknown or other
  misc_feature (426)..(426): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaactcattctttatgatgtcagtaatcggccccaggggtttctgatcgcttctatggctcaagtctgcctacacggcctcctgaccatcctcgggctccacgcctggacggacgagctgattacttattgtagttnatatacaaccagtgacacgttgggtgttcggcggagggaccaggcgtgaccgtcgtaggtcgagcccaggcctacgccccctcggtcacctccgtcgttcccgcctcccg

SEQ ID NO: 274757 - DNA, 705 bp, Homo sapiens
  misc_feature: GYAE6OF02G2WI7.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccccgcgatcgacgttggtgtcttataactttatcttgttggtaccgacacggacccaggcactcgtaccccaaactctattcttatgtatgtacagtaactccggtccccgtagggttctgtacgtcgtcttctatcgtctccgtaagtctcgaccctacgaccggtcctcccgtacgacctacttccgtcccgggtcctcccgacggtacccgtaggaacgggtacggacggtcttagtaacttttaacgttagtttcggttaacgtttactaattaacgtaacctaaaccgtagtacgtaaccgttacgtttgggggtacgtttcggggaccgggtacggggaaccgtacgggtacgtaccggtaacccgttccggtacggtaccgaccggtacccgtaacgggtcccgtacccggttcccccgtacggttaccgtacccgttacccgttcccggttccccgtaccccttcccgg

SEQ ID NO: 274758 - DNA, 718 bp, Homo sapiens
  misc_feature: GYAE6OF02GY418.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgcttataactttatctgttggtaccgacaggacccaggcactcgtacccccaaactctatttctttatgtatgtcagtaacgtccggccccgtaggggtttctgatcgtcttctagtcggctacctaagtctcgccctacgaccggtccctcccgtcgaaccctacgtccgtccgggcctccgacgtcccgtggacggacggtaggctagtatttaattagtttaggttacgttacgtattaactaacctaaccgtaggtacgtaacgtacgtttggggtacgtttacggggacgggtaacggggtaacccgtagggtaccgttacgggtaccccgggttaccgtacggggtacccgtaaaccgggtaccccggtaaaccgggtcccgttacccgggtacccccccgttaccggggttcccttaacccgttaccccggtttcccgggttccccccgtacccccgttacccccgg

SEQ ID NO: 274759 - DNA, 714 bp, Homo sapiens
  misc_feature: GYAE6OF02IGTK4.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataactttatctgttggtaccgacacggacccaggcactgtacccccaaactcatttctttatgtatgtctagtaagtccggccccgtaggggtttctgtactcgtcttctatcggcctaccaagttcctcgacccttacgaccggtcccttacccgtcgtaaccctacgttccgtcccgggcctcccgacgtccctaggacgggtacgaggtctaggttaactttactttagttcggttaacgtttccgtaattacgtaacctaacccgtaggttacgtaaccttacggttttaggggtcggtttacgggaccgggtaacggggtacccgtacgggtccgttacgggaaccccggttccgttaacgggtcccgaacgggtaccccgaaacggggtcccttacccggcccccccgttacgggttccctaacccgttccgttcccggtttcccccgaccccgttcccg

SEQ ID NO: 274760 - DNA, 725 bp, Homo sapiens
  misc_feature: GYAE6OF02IJ29A.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataactttatctgttggtaccgacacggaccaggcactcgtaccccaactcctattctttatgtatgtacagtaactccggaccccgtagggttttctgacgtcgtacttctagtcggtcctactaaggttctcgcctacgaccgtccctccctacgtaccacttccgtcccgggtcctaccgacgtaccgtaggaacgggtaaccggacggtacgttagtaacttttaagtttaacgtttacggttaacgttttaaccaagtttaacctaaaccgtaaaccgtaggtttacgaaccggtttacggttttgggggttacgtttacgggggacggggtaacggggaccggtaacgggccgttacggtacccggttaccgttacgggtacccgaacggtaccccggaagggtacccgtaccccggtccccgttcggttaccgtaccttacccggttccggttacccccgtcccttacccg

SEQ ID NO: 274761 - DNA, 739 bp, Homo sapiens
  misc_feature: GYAE6OF02G9VOR.27.23.C01.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaacccgngatcgacgttggtnacttaataactttatctgttggtaccgtacaggacccaggcactcgtccccaaactcattctttatgtatgtctagtaactccggaccccgtagggtttctgtatcgtcttctatcggtctaccaagtcgtgccctacgaccggtcccctaccctcgaacccacgttccgtacccggggctcccgacggtcccgtagggacggtaacggacggtccttaggtaattttaacgtttaagtttggttaagtttacctaagttaaccttaaactaaacccgtagtacgtaaccgtaacgttttcgggggttagtttaccgggggccggtaaacgggggtaaccgaaccggggttcctaccggttaaacccgggttccccgttaaagggtccgaacccggtacccggtaaacgggtcccgtaccccggtccccccgtttacgggttaccctaacccgttcccggtttaaccccggttccccccggttacccccttccccg

SEQ ID NO: 274762 - DNA, 605 bp, Homo sapiens
  misc_feature: GYAE6OF02G2OJC.27.23.C01.1.454.CMB.1.raw
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttaataactttntctgttggtaccgacaggacccaggcactcgtaccccaaactcattctttatgatgtcagtaatccggccccagggtttctgatcgcttctatggctccaagtctgccctacaccggtcctccctgacccatccgtccgggcctcccgacgtccgtggacggacgacggctgtatttattattgttagttcattataccaactagtagacgtacgtttgggtcgttcggacgggacgggaccgaggccgtcgaccgtccgtaggtccgaacggccccgtaagggtccctccggacccccgttcgggtacctacccgttccgttccggttacccccggcccttaccccgg

SEQ ID NO: 274763 - DNA, 656 bp, Homo sapiens
  misc_feature: GYAE6OF02H84IA.27.23.C01.1.454.CMB.1.raw
  modified_base (346)..(346): a, c, t, g, unknown or other
  misc_feature (346)..(346): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgtcttataactttatcttgttggtaccgacacggaccaggcactcgtacccaaatctatttctttatgtatgtctaagtaactccggacccctaggggtttcngatcgcttctatcggctcaagtctcgaccctaacaccggtccctacctacgacctagtccgtacccgggtcctccgacgtcccgtaggaacggacgaggtctaggtaactttatttagttacgttaagtttctaataactaaccaactagttcgaactaacggtttgggtcggttacgggacgggtaacgggtacccgaagggtacctaggtacccgtaccgttagggtaccacggacccgtaacgggccttaccgacccccgttcggtaccctaccgtttccgtaccgtttacccccacccgttacccg

SEQ ID NO: 274764 - DNA, 653 bp, Homo sapiens
  misc_feature: GYAE6OF02JGRVT.27.23.C01.1.454.CMB.1.raw
  modified_base (242)..(242): a, c, t, g, unknown or other
  misc_feature (242)..(242): n is a, c, g, or t
  modified_base (340)..(340): a, c, t, g, unknown or other
  misc_feature (340)..(340): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggngcttataactttatctgttggtaccgacaggacccaggcactgtaccccaaactctattctttaatcgatgtcagtaatccggcccctaggggtttcngatcgtcttctatggctccaagtctcgcctacacggtccctacctgacccactcgtccgggctaccgacgcctggaacgggacgaggcgtagtaatttagttacttgttagttcaattaactaactaaccgtagtacgtaccgtacgttacggggttcggtttaccgggcgggtaacggggtaccgacgggtaccttcgggtacccgttccgttagggtaccgtaacggtccccgaaagggtcccgttacccggtcccccgttaccggtccgtaaccgttcctttcccgggttacccctaccccgttaccccg

SEQ ID NO: 274765 - DNA, 662 bp, Homo sapiens
  misc_feature: GYAE6OF02FHOPX.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgctttataacctttatctgttggtaccgacacggacccaggcactcgtacccccaaactcatttctttatgattgtcagtaactccggcccccgtaggggtttctgatccgtcttctatcggctccaagtctgccctacgaccggcctccctcgaccctacgtccgtcccgggcctccacgcccgtaggaacgggacggtaggcgttagtaactttacttaagtttgttaacgtttctaattaccgtaacaaaccgtacgttagtaaccgtacggtttaggggttacgttacgggacgggtacgggaaccgaggtccgtacggtacccgttccgtacggtccgaacggtacccaaacgggtccctccggtcccccgttcggtcctaccttccgttccggttcccccgtacccgttcccg

SEQ ID NO: 274766 - DNA, 751 bp, Homo sapiens
  misc_feature: GYAE6OF02JUTK7.27.23.C01.1.454.CMB.1.raw
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggagttggggggggtcgtcgaggaggcgagcgctcgtcgggacgtcgtccaccatggcctgggcgtctgctattcctcaccctcctcactcagggcacagggtccgtgggcccagtctcggcctcgactcacgcctgcctccgtgtctgggtctcctggacagtcgntcaccatctcctgctactgggaaccccngatcgacgttgtgacttattaactttctacttgttcggtaccgtacgacggtaccgacggtcaaccgtcgtaccccaactctacttactttatctatgtactagtactccggtacccgtagggttccgttggtactccgtacttcgttacgtacggtcctaccgtaacggttcctacgtacccgtaccgacccgtacccgtccccgtacgtacccgtaccttcccggttaccggtccctaccgtaccgtacggttaccggacggaaaccggcggtacgttagtaactttacgttatttacggtaatttacgtaattacgtaaacctacgaacggttaacggtaccttaaccggtttggggttaccggttacggggtacgggtaccggtaaccggcgtaacggtccgtaaccggttccggtacggtaccgacggtacccgaaggttcccacccggttacccggtccgtacctaccggttcccgtacccggttcccaccccgttacccgg

SEQ ID NO: 274767 - DNA, 568 bp, Homo sapiens
  misc_feature: GYAE6OF02IVGRP.27.23.C01.1.454.CMB.1.raw
  modified_base (378)..(378): a, c, t, g, unknown or other
  misc_feature (378)..(378): n is a, c, g, or t
  modified_base (445)..(445): a, c, t, g, unknown or other
  misc_feature (445)..(445): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccatcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacacggacccaggcactcgtccccaaactcattctttatgatgtcagtaactccggccccgtaggggtttctgatcgcttctagtggctcagtctgcctacacgcctccngaccactcgtccggctccagcctgacggacgagctagtattattagttgtagttcattactacaacngtacgacgtacgttgggtgttcggacggagggaccgaggccgtaggtacccgttcgtacggtccacgcccgaaggtcctccggtcccccgtcggtcctacgttcctccggttcccctaccccg

SEQ ID NO: 274768 - DNA, 603 bp, Homo sapiens
  misc_feature: GYAE6OF02H9X5C.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcgggaacccgngatgacgttggtgcttataactttatctgttggtaccgacaggacccaggcactgtcccaaactcattctttatgtatgtcagtaactccggcccctaggggtttctgtatcgcttctatcggctacaagtctcgcctacaccggtcctcctgacctatccgtcccgggctccgacgtcctggacggacggaggctgtaactttatttagttgttacgttctaattataacgaacctagtcgactacgttgggtgttcgggacggtagggacccgtaggccttacggacccgttccgtacgggtcgaacggcccgaaggtccctccggcccccgtcggtcctaccgttccgtcgttcccccacccttcccg

SEQ ID NO: 274769 - DNA, 541 bp, Homo sapiens
  misc_feature: GYAE6OF02FU98Q.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgcttataactttatctgttggtaccgacaggacccaggcactgtccccaaactcattctttatgatgtcagtaatcggccccaggggtttctgatcgcttctatggctcaagtctgcctacacggcctccctgaccatcctccgggctccagcctgacggacgaggctgattattattgtagttcattactacaaccagtgacacttgggtgttcggcggagggaccaggctgaccgttctaggtcacgaccacggcctacgcccccgtgtcctacctctcgttccccgcccttcccg

SEQ ID NO: 274770 - DNA, 629 bp, Homo sapiens
  misc_feature: GYAE6OF02I1XHT.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtncttataactttatctgttggtaccgactaggacccaggcactgtaccccaactctattctttatcgatgtcagtaactccggtcccctaggggtttctgtactcgcttctagtcgctccaagtctcgacctacacggcctcctgacctatccgtccgggcctacccgagcctagacggtacgacggtctagtacttattagttaggtagttcattaactacaaccgtagtacgacgtagttcgggtagttcggacgggtacgggaccaggtcctacggtaccgttaccgtacgggtaccgacggacccgtaacgggtccctcccggtacccccgttcgggtacctcccgttaccgtttacccgttaccccgtaccccgttacccg

SEQ ID NO: 274771 - DNA, 703 bp, Homo sapiens
  misc_feature: GYAE6OF02HOQBV.27.23.C01.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (357)..(357): a, c, t, g, unknown or other
  misc_feature (357)..(357): n is a, c, g, or t
  modified_base (696)..(696): a, c, t, g, unknown or other
  misc_feature (696)..(696): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccccngatgacgttggngcttataactttatctgttggaccgacaggacccaggcacgtcgtaccccaaaactctatttctttatgtatcgtacagttaacgtcccgggacccccgtaggggttttaccnggtatccggtctttctagtcggaccttccgaaagttccgtcgacccttaaccgaccggtcccctcccgtagaccctacgtccgtacccgggctcccgacgtcctggaacggacgaggtcttaggtaatttaatttagttcgttaagtttacaacttaactaaccgaaaccctaggtacgttaaccgtaaccggtttggggttcggtttaccggggacgggaagggtaacccgaagggtccgttcgggtaacccgttccgtaacgggtctaaccggaacccgaagggtcccttacccggcccccgttacggtaccacccgtttccgtccgggtttccccnttccccg

SEQ ID NO: 274772 - DNA, 678 bp, Homo sapiens
  misc_feature: GYAE6OF02G1S0M.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataacttttatctgttggtaccgacaggaccaggcactgtccccaaactcattcttatgatgtcagtaatccggcccctagggtttctgatcgtcttctatggctccaagtctgcctacacggcctccctagacctatccgtccgggtcctccgacgcccgttaggacggaccggtacgggctacggtattttaagttagtttggtttaacgtttcgtaaattaacttaaccaaacctaggtacgtaaccttacgtttgggggttacgtttcggggtacgggtacggggaacccgtagggaccgttacggaccccgtttccgttacgggtaccgaacgggtaccccgtaaacgggtccgtacccggtccccccgttaccgggttaccgtaccccgttccgtttacccggttcccccgtccccgttaccccg

SEQ ID NO: 274773 - DNA, 716 bp, Homo sapiens
  misc_feature: GYAE6OF02GNHHV.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggngcttataacttttatctgttggtaccgacaggacccaggcactgtaccccaactcatttctttatgtatgtcagtaactccggccccgtaggggtttctggactcgtctttcgtagttcggctacctaaggtctcgacctacgaccggtccctcccgtgaccctacgtcccgtcccgggtcctacccgaccggtcctacgggacggacggacggtccgtagtactttaagtttagttagtttaagttcctaattaactaaccgtaaaccgtagttacgtaaccgttacggtttacggggttcggttttacggggaccggggtaacggggtaacccgagggtaccgtacggtacccggttaccgtacgggttaccgtaaccggtaccccggaacgggtcccgtacccggtccccccgttacggttccctaacccggtttccgttacccggtttccccccgtccccgttaccccg

SEQ ID NO: 274774 - DNA, 755 bp, Homo sapiens
  misc_feature: GYAE6OF02IBDLQ.27.23.C01.1.454.CMB.1.raw
  modified_base (256)..(256): a, c, t, g, unknown or other
  misc_feature (256)..(256): n is a, c, g, or t
  modified_base (651)..(651): a, c, t, g, unknown or other
  misc_feature (651)..(651): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgcccctgactcacgcctcgcccttccgtgtcgtgggtcctccgtaggactagtcgactccaacctacttcctcctgacctacgtaccgggaaccccgngtagtcggtacggttggtcgtactttaatttaactttatcgttggtttacggtaacccgacggtaaccggaccccgaggcctaccgttccgtaaccccctaaacttcttacttttactttagtcgtagttcgttacgtaagttaaccgtccccgggtaccccggttaggggttttctaggtactcgtcttacgtagtcggtccctacgtaacgtctcgtaccctacgaccggtcccttccgtacgacctacgtcccggtcccggtcctaccgaccgtccgtaggacgggtacggacggtctaggttaacttttaagttagttcggttatttacaattaaccgtaaccaacgtagtcgtacttacggtttgggttcgtccgggacggacggaccgnggtcgtcgtacccgttcgtacggtacgaccggtacccggaagtcccgtcccgtaccccgttcggaccttacccgttccgtacccgtttacccccacccttccgg

SEQ ID NO: 274775 - DNA, 700 bp, Homo sapiens
  misc_feature: GYAE6OF02JGQ1N.27.23.C01.1.454.CMB.1.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtcgtcgaggaggcagcgctctcgggacgtctccaccatggcctgggctctgctattcctcaccctcctcactcagggcacaggtcctgggcccagtctgccctgactcagcctgcctccgtgtctgggtctcctggacagtcgatcaccatctcctgacnctggaaccncgatgacgttggncttataactttntctgttgtacgtacaggaccaggtcactcgtccccaaactctaattctttactgtattgctagtaatccggccccctaggggtttctggactcgtcgttctagtcgtctacctaacgtcgttcgtaccgtaccaaccgggtccctcccgtcgtaccctacgttcctccggggtcctccgacgtcccttgggaacggcgaaggtcgtcgtaatttacgtttaagtttgttaggtttactaattacttaaccgaacctaaggtcgtaaacgtacgtttacggggttcgttacggggaccgggttacgggaaccggtgggtaacccgtcgggtaacccgttacctacgggttacgaaccggtacccgtaacggggtcctacccggtacccccgttccggggtaccaacccggtttccgttccggtttaccccctaccccgttaccccg

SEQ ID NO: 274776 - DNA, 654 bp, Homo sapiens
  misc_feature: GYAE6OF02I9Z6E.27.23.C01.1.454.CMB.1.raw
  modified_base (243)..(243): a, c, t, g, unknown or other
  misc_feature (243)..(243): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtncttaataactttatctgttcggtaccgacaggacccaggcactcgtaccccaaactctatttctttatgtatgtctagtaactccggcccctaggggtttctgatcgtcttctagtcggtctcctaagtctacgtccctaacgaccggtcccttccctacgaaccctacttcccgtccgggtcctacccgacgtcccgtaggaacgggacggaggtctaggtaattaatttagttgttagttactaagtaactaacaactaggtacgtacgttacggttgggtacggttcgggacgggacgggtaccgaggtacgtacggtacccgttcgtaacggtcgaaccggtaccgtaggtcccgtccgtcccccgttcgtcctaccgttccgttcccggttccccgcccttacccg

SEQ ID NO: 274777 - DNA, 638 bp, Homo sapiens
  misc_feature: GYAE6OF02J0GD6.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgtcctgactcacgcctgcctccgtgtctgggtctcctggacagtcgatcaccatctcctgcactggaacccnatgacgttggtncttaataactttntctgttggtaccgacaggacccaggcactgtaccccaaactctattcttatgatgtcagtaactccggcccctagggtttcngatcgcttctanggctacagtctgcctacacgtccctccgtcacctcgtccgtccgtctaccgtgaccgtggaaccggacggtacgtcgtaacgttatttaacgttagttacggttacgtttactaattaacctaacctaacgtacggtacgtaccgttacgggttgggttacgttccgggacgggtaacgggaccgtaggtcgtaccggtaccgtcgtacggtaccgaacgacccgtaggtccgtacccgtccccggttcgtacctacccgtttcggtacccttccccgtaccttacccg

SEQ ID NO: 274778 - DNA, 643 bp, Homo sapiens
  misc_feature: GYAE6OF02JDGAO.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggncttataactttntctgttggtaccgacacggacccaggcactcgtaccccaactcatttcttatgatgtcgagtaactccggcccctaggggtttctgacttcgtcttctatcggtcctcaagtcctcgccctacgccggtcctccctgaccctactccgtcccggtcctccgacgtccgtaggacggacgaggtctagtaattagtttagttgttacgttctaattactaacctaaccgtgtacgtacgtacgtttgggtacgttcgggcgggtaacgggccgacgggtccgtacggtacccgtcgttacggtaccgtacggtacccgaacgggtcccttccggtaccccccgttcggttccctacccgttcccgttacccgtttcccccacccttacccg

SEQ ID NO: 274779 - DNA, 631 bp, Homo sapiens
  misc_feature: GYAE6OF02G8F9F.27.23.C01.1.454.CMB.1.raw
  modified_base (444)..(444): a, c, t, g, unknown or other
  misc_feature (444)..(444): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatggacgttggtgtctttaataacttttatcttggttcggtaccgacgacggacccaggcactgtacccccaaactcattcttatgtatgtcagtaactccggccccgtaggggtttcctgactcgtacttctatcggctacctagtctcgcctacgaccgtcctccctgacctagtccgtaccgggctccgacgtccgtacggacggacggnggtctgtaatttagttattgtattctattatacaactgtcgacgtacgttggtgttcgggacggtacgggaccgaggcgtcgtaccggttccgtaaggtcccgaacgtaccccggaaggtccccgttccggacccccgttcgggttaccaccgtttccgttaacccggttccccctaccccgttccg

SEQ ID NO: 274780 - DNA, 550 bp, Homo sapiens
  misc_feature: GYAE6OF02GDQEO.27.23.C01.1.454.CMB.1.raw
  modified_base (441)..(441): a, c, t, g, unknown or other
  misc_feature (441)..(441): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaatcggcccccaggggtttctgatcgcttctatggctcaagtctgcctacacggcctccctgaccatcctccggctccagcctgaggacgaggctgattattattgttattcatatacaaccagtnactacgttgggtcgttcgggcggagggaccaggctcgaccgttcctaggtcacgcccgaaggtcctcgcccccgttcggtcctacctccttccgttcccacccttcccg

SEQ ID NO: 274781 - DNA, 607 bp, Homo sapiens
  misc_feature: GYAE6OF02GLF94.27.23.C01.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccccncgatgacgttggtgcttataactttntctgttcggtaccgacaggacccaggcactcgtaccccaaactcattactttatgtatgtcagtactccggcccctagggtttctgactcgtcttctatcggctaccaagtcctgccctacaccggtccctcccgtcgacctactccgtccgggcctccgacgccgtggacggacgacggtctagtatttattattgttagttcaattactaacaacctagtacgtacctacgtttgggtcgttccgggcgggacgggaccaggtctcgaccgttcgtacggtccaacggcccaaggcctccgtacccccgtcggtacctaccgttccgtccgttacccccacccttcccg

SEQ ID NO: 274782 - DNA, 579 bp, Homo sapiens
  misc_feature: GYAE6OF02FJO9I.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgctttataactttatctgttggtaccgacaggacccaggcactcgtaccccaaactcatttctttatgatgtcagtaatcggccccaggggtttctgatcgcttctatggctcagtctgcctacacgcctcctgaccatcctccgggctccagcctgacggacgaggtctagtattatattgtagttcatactacaacctagtcgaactacgttgggtgttcggacgggacgggaccaggcctacgacccgttccgtacggtacgacggacccgaaggtcctaccgcccccgttcggtacctaacccgttccgttccgttacccccacccttcccg

SEQ ID NO: 274783 - DNA, 589 bp, Homo sapiens
  misc_feature: GYAE6OF02FIFLK.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactcgtaccccaaactcatttctttatgatgtcagtaatccggcccccgtaggggtttctgatcgtcttctatggctccaagtctcgcctacgacgcctccctgaccatccgtccggctccacgcctgacggacgaggctagtattatattgttattacaattactaacaacctagtcactacgttgggtgttcgggcggacgggtaccgaggtcgtacgaccgttaccgtaggtccgaacggacccgaaggtccgttaccgcccccgttacggtccaccgttcctccgttaccccacccttacccg

SEQ ID NO: 274784 - DNA, 708 bp, Homo sapiens
  misc_feature: GYAE6OF02H0DV1.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatcttgttcggtaccgacaggacccaggcactcgtaccccaaacttcatttctttatgtatcgtactagttaacgtccggtacccccgtaggggttttcctgtactcgtctttctagtcggtctacctaagtctcgaccctacgaccggtcctcccgtcgacctacgtccgtcccgggcctaccgacgtccgtaggacggaccggacggtcttagtaatttacgtttagttagttaacgttctaattaactaacgtaaccgtaggtacgtaacgttacggtttcggggttcgttaccggggacgggtaacgggtaaccgtacgggtccgtaccggtacccgttaccgtacgggtaccgaaccggtacccgtaaagggtccgttaccccggtcccccggttacggtacctacccgttacccgttacccgggtttcccccgtccccgttacccgg

SEQ ID NO: 274785 - DNA, 577 bp, Homo sapiens
  misc_feature: GYAE6OF02JACVB.27.23.C01.1.454.CMB.1.raw
  modified_base (464)..(464): a, c, t, g, unknown or other
  misc_feature (464)..(464): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccccgcgatgacgttggtgctttataactttatctgttggtaccgacaggacccaggcactcgtcccaaactctattctttatgatgtcagtaatccggcccctaggggtttctgactcgtcttctatggtctccaagtctgcctacaccggcctccctcgaccacgtcctcccgggctcccgcgtccctgacggacgaggctgtattattattgttattctatactacaactagtanactacgttggtgtcggcgggaggaccgaggctgaccgttcgtaggtcgaacggacccgaaggtaccgtccggccccgtcggtcctaccttcgtcccttccctaccccttcccg

SEQ ID NO: 274786 - DNA, 839 bp, Homo sapiens
  misc_feature: GYAE6OF02H009Y.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggntcttataactttatctgttggtaccgacacggaccaggcactcgtaccccaaactctacttctttatgtattcgtactagttaactccgggtacccccgttaggggtttctgtactcgtcttctatcggcctactaagtctcgtacctacgaccggtccctccgtcgacctactccgtcccgggtcctccgacgtcccgtacgggacggtaccggaggtacttagtaacgtttagttttaacgtttaggttaacgtttaccgtaaacttaaccgttaaacctaaaccgtaacggttaaccggtaaacccgtttaccgggttttacgggggtttacgggttttacccgggggaaccgggggttaaaccggggaacccgggttaacgggtacccgtttaccggggtaacccccgggtttccccggtttaaacggggtaccccggtaaacccgggtaacccccgggttaaaccggggtaccccggtttaacccccgggtccccccccgggttttaccggggtaacccccgttaacccggttttacccccgggttttaccccggtttttcccccccccgggtaaccccctttaccccccggg

SEQ ID NO: 274787 - DNA, 595 bp, Homo sapiens
  misc_feature: GYAE6OF02HJK1O.27.23.C01.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactcggaacccgngatgacgttggtgcttataactttntcttgttggtaccgacacggacccaggcactcgtccccaaactcattcttatgatgtcagtaatccggccccgtagggtttctgatcgcttctatggctcaagtctgcctacacggcctcctgaccagtcctccgggctccacgtccctggacggacgaggctagtatttaagttgttagttagtttacattactaacctaactagtagactacgttgggtgttcgggcgggtacgggaccgaggtcgtcgtacccggtccgtaggtccgacggacccgaaggtcctccggtcccccgtcgtcctaccgttcccgttccgttccccgtacccttacccg

SEQ ID NO: 274788 - DNA, 573 bp, Homo sapiens
  misc_feature: GYAE6OF02F5NXO.27.23.C01.1.454.CMB.1.raw
  modified_base (458)..(458): a, c, t, g, unknown or other
  misc_feature (458)..(458): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaactccggcccccgtaggggtttctgatcgtcttctatggctaccaagtctgcctacaccggcctccctgaccatccgtccgggtcctccagcctggacggacgaggctgattattattgttattcattactacaactttagntactacgttgggtgttcgggacgggtagggaccaggctacgacccgtcgtacggtcacggacccaaggctccgcccccgtcggtccaccgttccgttccgttccccgaccctccg

SEQ ID NO: 274789 - DNA, 576 bp, Homo sapiens
  misc_feature: GYAE6OF02FNXCE.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccccgcgatgacgttggtgcttataactttatctgttggtaccgacaggacccaggcactgtccccaaactcattctttatgatgtcagtaactccggcccccgaggggtttctgatcgcttctatggctccaagtctgccctacgaccggccctccctcgaccatccgtccgggcctccgacgccgtaggacgggacgaggctgtatttattagtttgtagttctattactaacaactagtcgactacgttgggtgttcgggcggacggaccaggctgaccgtcgtaggtcgacgacccaaggccgtccgtccccgtcggtccaccttcgtccgttccccgccctcccg

SEQ ID NO: 274790 - DNA, 580 bp, Homo sapiens
  misc_feature: GYAE6OF02FW0DX.27.23.C01.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaacccgngatgacgttgtgcttataactttntctgttggtaccgacaggacccaggcactgtacccccaaactcattctttatgatgtcagtatccggaccccagggtttctgatcgtcttctatggctccaagtcctgcctacgacggccctccctgacccattcccgtccgggcctcccacgcctaggaggaccgaggctgtaattattagtttgttagttctaattactaacctaacagttagactacgtttggggtgttcgggcggagggacctaggctcggaccgtcgtaggtcaacgaccgaaaggcgtccgccccgtcgtacctaccgtctcccgttcccacccttcccg

SEQ ID NO: 274791 - DNA, 554 bp, Homo sapiens
  misc_feature: GYAE6OF02F6SM9.27.23.C01.1.454.CMB.1.raw
  modified_base (242)..(242): a, c, t, g, unknown or other
  misc_feature (242)..(242): n is a, c, g, or t
  modified_base (495)..(495): a, c, t, g, unknown or other
  misc_feature (495)..(495): n is a, c, g, or t
  modified_base (537)..(537): a, c, t, g, unknown or other
  misc_feature (537)..(537): n is a, c, g, or t
  modified_base (549)..(549): a, c, t, g, unknown or other
  misc_feature (549)..(549): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggngcttataactttatctgttggtaccgacaggacccaggcactcgtaccccaaactcattctttatgatgtcagtaactccggcccccgtaggggtttctgactcgtcttctagtcggctcctaagtctcgccctacgaccggtccctccctgaccatccgtccgggctccagcctggacggacgaggctgatttatattgttagtcatactacaacctagtcactacgttgggtcgttcgggcggagggaccnggcgtcgaccgtctaggcacgccgaggctccgcccctgtccnctctcgtccccncctcc

SEQ ID NO: 274792 - DNA, 825 bp, Homo sapiens
  misc_feature: GYAE6OF02F39BU.27.23.C01.1.454.CMB.1.raw
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataacttntctgttggtaccgacaggacccaggcactcgtaccccaaatcattctttatgtatgtactaagttaacgtccgggtcccccgtagggggttttcctaggtaacttccggtctttacgttagttcgggacctacccgtaagttcctacggtaccccttaaccgaccgggtccccttcccgtacgacccgtacgttcccgtcccgggcttcccacgtcccgtaggaacgggtacggtacgggtacctgggttaactttaagtttaacgtttggttaacggtttacctaacgttaaccgtaaaccgtaaacccgtaagggttaccgtaaccgttaccgggttttagggggtttccggtttaccggggggtaccgggggtaaccgggggtaaccgtacggggtaccgttaccgggtaacccgggtttcccgttaacggggttaccccgtaaccgggtaaccccgtaaaccgggggtccccgtttccgggttaccccccggttacccgggttacccgttaacccgtttccccggtttaccccgggttttcccccccgtacccccgtttaccccgg

SEQ ID NO: 274793 - DNA, 620 bp, Homo sapiens
  misc_feature: GYAE6OF02G7OKW.27.23.C01.1.454.CMB.1.raw
  modified_base (350)..(350): a, c, t, g, unknown or other
  misc_feature (350)..(350): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacacggacccaggcactcgtaccccaactcattctttatgatgtacagtaactccggccccgtagggttctgatcgcttntatggctacaagtctgacctacacggtcctccctcgacctactccgtccgggtcctccgacgcccgtaggacggtacgacggctagtatttattagttcgttagttactataactacaacctagtacgactacgttgggtcgttcgggcggtaacgggaccgtaggtcgtacggaccgtccgtaggtccgtaacggacccgtaaggtccgttaccggtcccccgtcggttaccctaccgttccgttcccggttccccgcccgttaccccg

SEQ ID NO: 274794 - DNA, 672 bp, Homo sapiens
  misc_feature: GYAE6OF02GR9OL.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccccgngatgacgttggtgtacttataactttatcttgttggtaccgacaggacccaggcactcgtacccaaactcattctttatgtatgtacagtaactccggtccccgtaggggtttctgtacgtcgtcttctagtcggtctaccaagttctcgtacctacgagtcggtccctcccgtcgaccctactcccggtccggctcccgacgtccgtaggacggacgacggtctgtactttattagttgtacgttactaactaactaaccaaccgtagttacgaacgttacggtttggggtcggtttccgggacgggtaacgggtaccgtaacgggtccgttacggtaccccgggttcgttaacgggtcccaaccggacccggtaacggttcccgtcccgtcccccgttcgggtccctaccgtcccgttaccgttccccctaaccccg

SEQ ID NO: 274795 - DNA, 653 bp, Homo sapiens
  misc_feature: GYAE6OF02GOWTS.27.23.C01.1.454.CMB.1.raw
  modified_base (417)..(417): a, c, t, g, unknown or other
  misc_feature (417)..(417): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtatgggtctcctggacagtcgatcaccatctcctgcactggaacccgcgatgacgttggtgctttataactttatctgttggtaccgacaggacccaggcactgtccccaaactcattctttaatgatgtcaagtaagtccggcccccgtaggggtttctgactcgtcttctagtcggctccaagtctgccctaacgaccggtccctccctcgaccatccgtccgggcctccganccgtggacggacgaggctagtattattattgttagttacatactaacaacgtagtacgtacgtagtttggggttgttaccgggagggtaaccgggacccgtaggtccgttacggtaacccggttccgtacggtccgaaccggtaccccggtaaacggtcccggttacccggtaccccccgtttacggttccctaacccgtttcccgtcccgtttacccccccgtacccttcccccg

SEQ ID NO: 274796 - DNA, 565 bp, Homo sapiens
  misc_feature: GYAE6OF02GEI1J.27.23.C01.1.454.CMB.1.raw
  modified_base (232)..(232): a, c, t, g, unknown or other
  misc_feature (232)..(232): n is a, c, g, or t
  modified_base (415)..(415): a, c, t, g, unknown or other
  misc_feature (415)..(415): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgcttataactttatctgttggtaccgacaggacccaggcactgtccccaaactcattctttatgatgtcagtaatccggccccctaggggtttctgatcgcttctatggctccaagtctgcctacacggcctccctgacccatccgtccgggctccgacgcctgaggacgnggctgattattattgtagttcatatacaccagtcactacgttgggtgttcgggcggtacgggaccgaggcgtcgaccgtcgtaggtcgacgcccgaacggtcctccgtcccccgtcggtcctaccgtccgttccgttccccgccctcccg

SEQ ID NO: 274797 - DNA, 644 bp, Homo sapiens
  misc_feature: GYAE6OF02HIECY.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (347)..(347): a, c, t, g, unknown or other
  misc_feature (347)..(347): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccngatgacgttggngcttataactttatctgttcggtaccgacaggacccaggcacgtcgtacccccaaactctatttctttatgtatgtacagtaacgtccggccccgtagggtttcngatcgtcttctatcggtctaccgaagtcctcgacccgtacgaccggccctacccgtacgaccctacgtccgtcccgggtctcccgacgccgtaggacggacgaggtctagtatttattagttgttattacattaactacaacgtagtacgaccgtagtttacgggtcggttcgggacgggtacgggtaccaggtccgtacggtcccgtacgtacggtccgaaccggcccgtaacggcctacccggtccccgttcggaccctaccgttccgtccccgtttaccccaccccgttacccg

SEQ ID NO: 274798 - DNA, 677 bp, Homo sapiens
  misc_feature: GYAE6OF02F5C9E.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtncttataactttatctgttggtaccgacgacggacccaggcacgtcgtaccccaactctatttctttatgatgtcagtaactccggcccctaggggtttctgtactcgtcttctagtcggctccgaagtcctcgccctaacgaccggtccccttccctcgaaccctacgttcccgtcccgggtcctcccgacgtccgtaggacggacggaggtccgtagtatttagttagttgttacgttactaataactaaccaacctaggttacgaacgtacggtttgggttcggttaccgggacgggtacgggaccgtacggtccgtacgtacccggttccgtacggtaccgtaacggacccgaaacgggtcccgtacccggtcccccggtacggttccctaacccgttcccgttacccggttacccccacccgttaccccg

SEQ ID NO: 274799 - DNA, 700 bp, Homo sapiens
  misc_feature: GYAE6OF02HYY6E.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttaataactttatcttgttggtaaccgacacggacccaggcactcgtccccaaatcattcttatgatgtcagtaactccggcccctagggtttcctgtactcgtcttctattcggctccgaagtctcggcctacgaccggcccttccctagaccctagttcccgtcccgggctcccgacgtcccgtaggacgggaccggtagggccttagtactttaactttaagtttggttaacgtttcaagttaactaaacccgtaaaccgtaagttacgaaccttacggtttggggtttacggttaccggggacgggtaacgggaccgtacggtccgttaccggacccggttaccgttacgggtaccgaacggtaccccgaaacgggtcccgttaccggccccccgttcgggttaccctaccgttacccgttcccggtttacccccgtcccccgttacccgg

SEQ ID NO: 274800 - DNA, 673 bp, Homo sapiens
  misc_feature: GYAE6OF02FTRTA.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaactcggccccctaggggtttctgatcgtcttctagtcggctcaagtctcgctacgacggcctccctgaccatccgtccgggtctccacgcctgacggacgacggctagatttatattgtacgttctatactactaacctagtacgtacgtaacgttggggttacgtttcggggacggacggggtaacccgtacgggtaccgttaccggtaacccggttcccggttaacgggtaccgtaaacccgggtaccccgtaaacgggggtcccgttacccgggtaccccccccgtttacggggtacccgtaaccccgtttcccggtttccccggtttacccccccgtcccccgtttaccccccg

SEQ ID NO: 274801 - DNA, 908 bp, Homo sapiens
  misc_feature: GYAE6OF02G71EN.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactcgggaaccccngaatggacgttgggtgactttaataacttttatccttgttcggtaccgacacggacccaggcactcgtaccccaaactcactttcttttatcgatcgtacaaggtaaactccggcccccgttaagggggtttctacggtaacttcggctttacctaacttcgggtcctacccgtaaaggttcctcgtaccccttaaccgacccgggtaccccttaccccgtacggtaaccctacgttacccgttccccgggggtacccttacccgtaacggtaccccggttgggaacggggtaaaccggaaccggggtccttaacgggttaaacgtttttaaccggtttttaaagttttacgggtttaaacgggttttacccttaaaagtttaaccgtaaacccgtaaaacccgtaaggttaaccgttaaaccgttaccgggtttttacgggggttaccggggttttaccggggaccgggggtaaacgggggtaaccccggtaaaggggtacccgttaccgggttaaccccggttcccggttaaacggggttacccgaaaccgggtaacccccgtaaaacggggttcccgttaccccggtaccccccccggtttacggggttacccctaccccggttttaccccgtttacccggtttacccccccgtacccccgtttaaccccgg

SEQ ID NO: 274802 - DNA, 705 bp, Homo sapiens
  misc_feature: GYAE6OF02G7KXB.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactcggaacccngatgacgttggntcttaatactttatcttgttcggtaccgacacggaccaggccactcgtaccccaaactctatttctttatgtatcgtacgtagtaacgtccgggacccccgtaggggtttctcgtatccgtctttctagtcggcctacctaagtctcgtaccctacgaccggtccctccgtacgacctacgttccgtcccgggtcctccgacgtccgtaggacggacggaggtctagtactttattagttggttacgttactaattaactaacctaaccgtagttacgtaccgttacggtttggggttacggttaccggggtacgggtaaccgggtaccgtacgggtccgtacggtacccggttaccgttacggtaccgaccggtacccgtaacgggtcccgttacccggtccccccgttacgggtaccctaccgtttcccggttacccggtttcccctaccccgttacccgg

SEQ ID NO: 274803 - DNA, 645 bp, Homo sapiens
  misc_feature: GYAE6OF02JOAU8.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggngcttataactttatctgttggtaccgacaggaccaggcactcgtaccccaaactctattctttatgtatgtcagtaactcggccccgtaggggttctgactcgtcttctatgctcctaagtctacgcctacgaccgcctccctacgacctacgtccgtccgggtcctccgacgtcccgtggaacggacgaggtctagtacttaattagttagttacgtttacaattaactaaccaaccgtagtacgaccgttaacgtttggggttacgttccgggacgggtacgggtaccgtacggtaccgttacggtacccgttcgtaacggtccgaacggtccgtaacggtccgtccgtacccccgtcgggttaccaccgttacccttccggttaccccaccccgttacccg

SEQ ID NO: 274804 - DNA, 591 bp, Homo sapiens
  misc_feature: GYAE6OF02GNT7W.27.23.C01.1.454.CMB.1.raw
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
  modified_base (579)..(579): a, c, t, g, unknown or other
  misc_feature (579)..(579): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaaccccgngatgacgttggntcttaataactttatctgttggtaccgacaggacccaggcactgtccccaaactcatttctttatgatgtcagtaatccggccccaggggtttctgatcgcttctagtggctccaagtctcgccctacgaccggtcctccctcgacctactcctccgggcctccacgctgacggacgaggctgtatttattagttgttagttcattaatacaactagtacgactacgttgggtgttcgggcgggtacgggacctagggctacgaccgttcgtacggtcacggccaacgggcgtccgtcccccgtcggtcctaccgtcccgttccgttaccccncccgttaccccg

SEQ ID NO: 274805 - DNA, 573 bp, Homo sapiens
  misc_feature: GYAE6OF02FUKBR.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactcgtccccaaactcatttctttatgatgtcagtaatccggcccctaggggtttctgatcgcttctatgctcagtctgcctacgacggcctcctcgaccatccgtccgggcctccgacgcctggaggacgaggctagtattagttattgttagttcaagttatacaacctagtagactacgtttgggtgttcgggcggacgggaccgaggtctcgaccgtcgtacggcgacgacccgaggtccgtacgtcccccgtggtcctacctccgtccgttcccacccgttcccg

SEQ ID NO: 274806 - DNA, 577 bp, Homo sapiens
  misc_feature: GYAE6OF02HBWEU.27.23.C01.1.454.CMB.1.raw
  modified_base (244)..(244): a, c, t, g, unknown or other
  misc_feature (244)..(244): n is a, c, g, or t
  modified_base (473)..(473): a, c, t, g, unknown or other
  misc_feature (473)..(473): n is a, c, g, or t
  modified_base (501)..(501): a, c, t, g, unknown or other
  misc_feature (501)..(501): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtncttataactttatctgttggtaccgacacggacccaggcactcgtaccccaaactctattctttatgatgtcagtaactccggccccgtaggggtttctgtactcgtcttctatcggctacagtctcgcctacgccggtcctccctgaccactccgtccgggcctccgacgcctggacggacgaggtctagtatttacttagttgttattactatactaacaacagtanacgtagttgggtgtcgggcggacggacnggtctcgtaccgtcgtaggtcgacggacccgaggccgtccgccccgtcgtacctaccgtcgtcctcccacctcccg

SEQ ID NO: 274807 - DNA, 592 bp, Homo sapiens
  misc_feature: GYAE6OF02FPU4E.27.23.C01.1.454.CMB.1.raw
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccccgngatgacgttggtgcttataactttntctgttggtaccgacaggacccaggcactcgtaccccaactcattctttatgatgtcagtaatcggccccaggggtttctgatcgtctctatggctccaagtctgcctacgcggccttccctgacctactccgtcccgggctcccgacgtcctggaacggacggaggcttagaatttattatttgttaagtttcataacttaaccaactacgtcgactacgttgggttgttcgggcgggtacggggaccagggctcggtaccgtccgtaggtcgacggacccgaaggtcctccgccccgtcggtccaccgttcctcggttccccgcccttcccg

SEQ ID NO: 274808 - DNA, 618 bp, Homo sapiens
  misc_feature: GYAE6OF02FZEIJ.27.23.C01.1.454.CMB.1.raw
  modified_base (231)..(231): a, c, t, g, unknown or other
  misc_feature (231)..(231): n is a, c, g, or t
  modified_base (503)..(503): a, c, t, g, unknown or other
  misc_feature (503)..(503): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgctttaataactttatcttgttggtaccgacaggacccaggccactcgtaccccaaactctattcttttatgattgtcagtaatccggcccctaggggtttctgatcgtcttcgtagtcggctaccaagtctcgaccctacgacggcccttcctacgaccctacgtccgtcccgggtctccacgcctaggacggacgaggcgtagtatttatattgttagttctatactaacaactagtgactacgttgggtagttcggngggacggtaccgaggcctacgaccgttcgtaggtccgacggacccgtaacgggtcctaccgtcccccgttcggttacccaccgttcccgtccgtttacccccacccgttaccccg

SEQ ID NO: 274809 - DNA, 771 bp, Homo sapiens
  misc_feature: GYAE6OF02IDR5Y.27.23.C01.1.454.CMB.1.raw
tcagagcgtcgtctcacgaccggtgctcgatttagtacacgtgattagggattgggggggggtctcaggaggcagcgctcgtcgggacgtctccaccatggcctgggctctgctattcctcaccctcctcactcagggcacagggtcctcgggcccagtctcgccctgactcagcctgccttccgtgtcgtgggtctccgtggacagtcgatcaccatctcctgcactcggaaccgcgatggacgttggtcgtcttaataactttatcttacggttacggtaccgacgaccggaaccgaggcctactcgtacccctaaatcctaatttctttatgtactgtacgtataacgtcccggtaccccggttaggggtttactacggtacttcgtcgtttactacggtcggtaccttaaccgtaagttccgttacgtaccccgtttaaccgaacccgggttccccttacccgttacggacccttacgtcccgtacccgggtcctaccggacgtccggtagggaggtaaccggaggttacctagttaactttagtttagtttaacgttaacgtttactaactttaaacgaaacctaacgtagttaacgacgtttacgggttacgggttacggttcggggaacgggtaccgggaaccgacgggtaccgtacgggttaccgttacccggtaaggtccgaacccggtacccgacggtacccgtcccgtaccccggttgtacccgttccgttaccgttacccgtccccgtacccgtacccg

SEQ ID NO: 274810 - DNA, 575 bp, Homo sapiens
  misc_feature: GYAE6OF02HSGYW.27.23.C01.1.454.CMB.1.raw
  modified_base (230)..(230): a, c, t, g, unknown or other
  misc_feature (230)..(230): n is a, c, g, or t
  modified_base (447)..(447): a, c, t, g, unknown or other
  misc_feature (447)..(447): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgnatgacgttggtgcttataactttatcttgttggtaccgacaggacccaggcactcgtacccccaaactcatttctttatgatgtcagtaatcccggacccctagggtttctgtatcgtcttctatggctcaatctgcctacgaccggtcctccctcgaccactccgtccgggctccgacgccgtggacggacgaggctagatttattattgtacttnattacaacaacctagtacgactacgttgggtgttccgggcggacgggaccgaggctcgaccgtcgtaggcacgcccgaaggcctcgcccccgtacggtcctaccgtccgtcgttccccgccttacccg

SEQ ID NO: 274811 - DNA, 752 bp, Homo sapiens
  misc_feature: GYAE6OF02FF3NT.27.23.C01.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (359)..(359): a, c, t, g, unknown or other
  misc_feature (359)..(359): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatccaccatcctcctgcacgtggaaccccgngatggacgttggntcttataactttatctgtcggtaccgacacggaccaggcacgtcgtacccccaaactctatttctttaatgaattgtacaagtaacgtccgggtaccccgtaggggttttcnggtctcgtctttcgtagtcggtcctaccgaacgttcgtacgaccctaacgaccggtcccctcccgtacgaccctacgttccgtcccgggcctaccgacgccgtaggacggtacggaggtcttaggttaactttatttagtttacgttaacgttactaaattaaccaaacctaaaccggtaggttacgtaaaccggttacggttttagggggttacggttaccggggacggggtaaccgggaaccgtacgggtaccgttaccgggtaccccgtttaccggacggttacccggaaccggtaacccggtaacgggtcccgttaccccggtacccccggttaccggttaccctacccggtttccgttccccggtttacccccgccccgtttacccgg

SEQ ID NO: 274812 - DNA, 699 bp, Homo sapiens
  misc_feature: GYAE6OF02IWEYU.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtcgtgggtcctcctggacagtcgatcaccatctcctgcacgtacggaacccgcgatcgacgtttggtgtacttaattaactttatcttgttaggtaccgacgaacggaccccaggccacgtcgtacccctaaactctatttacttatgtatgtactaggtaacgtcccggaccccgtaggggtttctgtactcgtacgttctacgtcggtacctaccgtaagtcttacgtacccgttacgtaccccggtcccttacccgtaccgtaaccctaccgttcccggttcccggccgtacccgacgtccgtaggacgggacggaggtccgtagttaactttagttagttagttaacgtttactaactaactaaccgtaactaggtacgtacgtacggtttgggtacggtcgggacggacggaccgtaggcgtacgtaccggtcgtacgtaccgacgacccgtacggcctcccggtacccgttcggtaccttaccgtccgttcccgttcccgtcccgtaccg

SEQ ID NO: 274813 - DNA, 815 bp, Homo sapiens
  misc_feature: GYAE6OF02H17OT.27.23.C01.1.454.CMB.1.raw
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatccaccattcctcctgcacgtcggaacccngatggacgttggngtacttaattaactttatcgttggttggtaccgacgacggacccaggcactcgtaccccaatctattactttatgtatgtacgagtaaccgtcccggtaccccggttagggttttcctagtacttccggtcctttacgtagtcggtccttaccgtaacgtcttcgtacccgtacgacccggtacccttcccgtacgtacccgtacgtcccggttcccgggtacctaccgtaccgaccggtacgggacggtacgggtacggtcctaggttaacttttaacgttttaagtttcgttaacgtttacctaagtttaaacctaaccaaaccgtaacggtaacgtaccgttaacggtttcgggggttacgggtttaccggggaccggggtaacgggtacccggtaacgggttaccgttaaccgggttaccccgttacccgggttacggtaccccggtaacgggtaacccccggttaagggtacccccgttccccgggttacccccgttaccgggttcccctaaccggtttccccgtttcccccggttaccccccgttccccgttaccccgg

SEQ ID NO: 274814 - DNA, 569 bp, Homo sapiens
  misc_feature: GYAE6OF02FVZLD.27.23.C01.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (372)..(372): a, c, t, g, unknown or other
  misc_feature (372)..(372): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccncgatgacgttggtncttataactttntctgttgtaccgacaggaccaggcactgtaccccaaactcattctttatgatgtcagtaatcggccccagggtttctgatcgcttctatggctcaagtctgcctacgcgcctcctnacctatcgtccggctccacgcctgacggacgaggctgtattattatttgttagttcattactaacaacctagtacgacgtacgttgggtggttcggcgggacgggaccgaggcgtcgtaccgtacgtaggtacgacggacccgaaggtccgtccgtccccgtcggtcctaccgtcgtccgttccccgtcccgtcccg

SEQ ID NO: 274815 - DNA, 587 bp, Homo sapiens
  misc_feature: GYAE6OF02GIL7L.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttaataactttatctgttggtaccgacaggacccaggcactgtaccccaactcattcttatgatgtcagtaactccggcccctaggggtttctgatcgtcttctatcggctcctaagtctgccctacgaccggtcctccctgtaccatccgtccgggctccgacgtcctggacggacgaggctagtatttattagttgtagttctatataacaacctagtcgactacgtttgggtgttcggacgggtacgggaccaggcctcgaccgttcgtacggtcgacgacccgtaaggcctccgtaccccgtcggtacctccgttccgtccggttccccgccctcccg

SEQ ID NO: 274816 - DNA, 685 bp, Homo sapiens
  misc_feature: GYAE6OF02F6N4O.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtnacttataactttatctgttgtaccgacaggaccaggcactcgtaccccaaactcatttctttatgatgtcaagtactccgggccccgtaggggtttctgactcgtcttcgtagtcggtctaccagttcctcgccctaacgaccggtccccttcccgtacgaccctacgttcccgtacccgggctcccgacgtcccgtaggacgggacgtaggcttaggtaatttagttagtttggttacgttactaagttactaaccgtaactaggtacgtacgttacggtttggggttcggtttaccggggacgggtacgggtaccgtagggtccgtacggtacccggttaccgtacgggtaccgaaccggtacccgaacgggtcccgtcccggtccccccgttacggtacccttaccgttccgttcccgttaccccctaccccgttacccg

SEQ ID NO: 274817 - DNA, 712 bp, Homo sapiens
  misc_feature: GYAE6OF02JEFFR.27.23.C01.1.454.CMB.1.raw
  modified_base (256)..(256): a, c, t, g, unknown or other
  misc_feature (256)..(256): n is a, c, g, or t
  modified_base (508)..(508): a, c, t, g, unknown or other
  misc_feature (508)..(508): n is a, c, g, or t
tcagagcgtcgtctcacgaccggtgctcgatttagtacacgtgattagggagttgggggggggtctcaggaggcagcgctctcgggacgtctccaccagtggcctgggctctgctattcctcaccctcctcactcacgggcacagggtccctgggcccagtctgccctgactcagcctgcctccgtgtctgggtcctccgtggacagtcgatcaccatcctcctgcacgtcggaacccgcgagtcggacggttggnggtccttaattaaaccttttatcttggttcggtaccgacgacggacccaggctacgtcgtaccccaaactctatttcttatgtatgtacaagtaacgtccgggtcccccgttagggttctgtatccgtcttctagtcgcctaccgtagtcgtctcctacggacgtccccgtcctacgcctacgtccgtccggctcccgtacgtccgtggaacggcggtacgcgttagtacttattacgtttagttacgttanaagttaacgtaacctaaaccgtgtaacgtaacgtacggtttcgggtacggttccggggacgggtaaacggtccgacggttaccgttacgggtacccgtttacggacggtaccgaacccggtaccgtaccggtaccgttccccggtacccccggtacgttacccgtacccgtcccgttcccgttacccccgtccccttaccccgg

SEQ ID NO: 274818 - DNA, 695 bp, Homo sapiens
  misc_feature: GYAE6OF02GTM9O.27.23.C01.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggacccngatgacgttgncttataactttntctgttggtaccgacgacggacccaggcactcgaccccaaactctattcttangtatgtctagtaactccggtaccccgtaggggtttcngtatccgtcttctatggtcctaccgaagtcctgacccttacgacccgggtccctccccgtacgaccctacgttcccgtacccggggtcctacccgacggtcccgtagggaacgggtaccgaagggtccttagtaattttaagtttacggtttagttaagtttacattaactaacctaaaccgtaggttacgaaccgttaggtttcggggttcggttacggggacgggtaacgggaccctagggtccgtaccgggtaccgttaccggttacggtaccgaacggtacccgaaacgggccttacccggtccccgttcggtacctaccgttcctcccggtttccccgccccttacccg

SEQ ID NO: 274819 - DNA, 636 bp, Homo sapiens
  misc_feature: GYAE6OF02H72HK.27.23.C01.1.454.CMB.1.raw
  modified_base (231)..(231): a, c, t, g, unknown or other
  misc_feature (231)..(231): n is a, c, g, or t
  modified_base (627)..(627): a, c, t, g, unknown or other
  misc_feature (627)..(627): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtggaacccgngatgacgttggtgtctttataacttttatcgttgttcggtaccgacgacggaccaggcactcgtacccaactctattctttatgtatgtactagtacgtccggccccgtagggttcagtacgtcgtcttctagtcggcctactacgtctcgacctacgaccggtccctccctacgacctactccgtcccggctccgacgtccgtggacggacggaggtctacggtatttagttagttagttacgtttactaattactaaccaacgtagtacgtaactacggtttgggtcgttacgggacgggtacggaccgtaggtctcggtacctaccggttacggtacgcggacccgtagcccgttccgaccccggttcgtccgtccgttcctccgttaccccnccgtacccg

SEQ ID NO: 274820 - DNA, 678 bp, Homo sapiens
  misc_feature: GYAE6OF02JN1DV.27.23.C01.1.454.CMB.1.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaacccngatgacgttggtncttataacttatntgtggtacactaggaccaggcactcgtacccaactctattcttangtatgtcagttaacgtccggtcccgtagggtttcngtactcgtctactgtcggtcctacgtaagttctcggtacctacgtaccggtcctcccgtagaccctacttccgtccggtcctcccgtaccgtaccgtacggtaacgggacggacggtacgtacgtaagtttattacgtttacggttactttacgtaacttactaaaccgtaaaccgtacggtaacgttaaccgttagttcggggttcggttaaccggggtacgggtacgggaccgtacggtcgttacggtacccgtaccggttacggtaccgaaccggtaacccgtacggtcctcccggtacccgttcggtacttacctcgtttcccgtacccgtccctacccgg

SEQ ID NO: 274821 - DNA, 544 bp, Homo sapiens
  misc_feature: GYAE6OF02F27D7.27.23.C01.1.454.CMB.1.raw
  modified_base (243)..(243): a, c, t, g, unknown or other
  misc_feature (243)..(243): n is a, c, g, or t
  modified_base (418)..(418): a, c, t, g, unknown or other
  misc_feature (418)..(418): n is a, c, g, or t
  modified_base (458)..(458): a, c, t, g, unknown or other
  misc_feature (458)..(458): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggngcttataactttatctgttggtaccgacaggacccaggcactcgtccccaaactcattcttatgatgtcagtaagtccggccccgtaggggtttctgatcgcttctatggctcaagtctgacctacgacggccctccctcgacctagtcctccgggctccgagcctgacggacgngcgtgattatattgttagttcatactactaacagtagacncgttgggtgttcggcggaggacaggcgcgacgtcgagtcgacgcccaggctccgcccgtggtccaccttcgtccgtcccgcctccc

SEQ ID NO: 274822 - DNA, 689 bp, Homo sapiens
  misc_feature: GYAE6OF02HH4M9.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgtcttataactttatcttgttgtacgactaggaccaggcactcgtacccaaatctatttcttatgtatgtactagttaactcccgggtcccccgtaggggtttctgtatcgtcttctagtcggctactaagtctcgcctacgcggtccctccgtcaccatccgtcccgggctccgacgccgtagacggacgaggtactaggtactttaattagttgttacgttactattaactaacaaccgtaggtcgaaccgttacggtttagggtcggtttaccgggacggggtaacgggtaccgtagggtaccttaccgggtacccgtaccggttagggttaccgaaccgggtaccccgtaaacggggtcccttaccccggtaccccccggttccgggttaccctaaccccgtttcccggtttacccggtttaccccccaccccgttaccccg

SEQ ID NO: 274823 - DNA, 694 bp, Homo sapiens
  misc_feature: GYAE6OF02IBEVY.27.23.C01.1.454.CMB.1.raw
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgacctcagcctgcctccgtgtctgggtcctcctggacagtcgatcaccatctcctgcactcggaacccgcgatcgacgttggtgcttataactttatcgtgttggtaccgtacacggaccaggcactcgtaccccaaacgtctatttctttatgtagtgtactagtaactccggcccccgttaggggtttcagtactcgtcttacgtagtcggtcctaccgtaagtcgtcgtaccctaaccgaccggtccccttacccgtacgtaaccctacgtccggttaccccgggtccttacccgaacggtccctaggacggaccggaggtctagtaatttagtttagttaggttaacgttcaaagttaattaaccgaacctaggttataaccgttaggtttgggtcggttacgggacggggtaacggaccgtaggtccgtacgtaccggtccgtaggtccgaacggtacccgaacggtccgtaccggtccccgtacggtcctaccgttccgtaccgttacccctacccgtacccg

SEQ ID NO: 274824 - DNA, 633 bp, Homo sapiens
  misc_feature: GYAE6OF02IV6ZA.27.23.C01.1.454.CMB.1.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacngtcgatcaccatctcctgcacgtggaacccgcgatgacgttggtagtcttattaacttttntcttgttaggtaccgacacggaccaggcactcgtaccccaaactctacttctttagtgacttgtacaagtaacgtccggaccccgtaggggtttctacgtactccgtacttcgtaagtcggtctaccgaagtcgtcgtacccttacgaccgtcccttccgacgaacctacgtccgtccggtcctccgacgtccgtaggacggtacgacgtctagtactttagttacgtgttacgttcaataacctaacacgtagtacgtacgtacgtttggtacgttcgggcgggaacgtacgagtcgtacgaccgtcgtaacggtcacgacctaggcctcgaccccttcggtacctcgttcctccgttaccccgaccctaccgg

SEQ ID NO: 274825 - DNA, 671 bp, Homo sapiens
  misc_feature: GYAE6OF02GAAID.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatggacgttggtgcttaataactttatcttgttggtaccgacaggacccaggcactcgtaccccaaactctatttctttatgtatgtcaagtactccggccccgtagggtttctgatcgtcttcgtatcggtctccaagtcctgcctacgaccgtccctcctcgacctactccgtccgggcctccgacgccgtggacggacgaggtctagtatttagttagttaggttattactaagttaactaaccgtaacctaggttacgtaaccgttacggtttggggttacgttccggggaccgggtaacgggtacccgtaggtaccgtcggtacccggttacgttacgggtaccaaccgggacccgtaacggtcccgttacccggtcccccggttccggttacctacccgttcccgttacccggttcccccgtaccccttccccgg

SEQ ID NO: 274826 - DNA, 718 bp, Homo sapiens
  misc_feature: GYAE6OF02H4QP3.27.23.C01.1.454.CMB.1.raw
  modified_base (237)..(237): a, c, t, g, unknown or other
  misc_feature (237)..(237): n is a, c, g, or t
  modified_base (361)..(361): a, c, t, g, unknown or other
  misc_feature (361)..(361): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacaggtcctgggcccagtctgccctgactcagcctgcctccgtgtctgggtctcctggacagtcgatcaccatcctcctgcactcggacccgaaaaacgntgacgttggtgtctttataacttttatcttgttcggtaaccgacacggacccaggcactcgtaccccaaatctaatttcctttatgtactgtactagtaactccggaccccgttaggggtttcngtactccgtcttcgtatggcctacgaagtctcgaccctacgaccggtcccttccgtacgaaccctacgttccgtcccgggtcttacccgacgtcccgtagggaacggacggtaggtccttagtaattttagtttattgttacgtttacaattacctaactaacctagtacgaccgttacggtttcgggtcggttccgggacgggtacgggtaaccgtagggtaccgtacgggtaacccgttcggttaacggtaccggaaccggtaccccgtaaacggggtccctttacccggccccccgttacgggttcccctaaccgtttcccggttccgtttaccccccgacccctttaccccgg

SEQ ID NO: 274827 - DNA, 755 bp, Homo sapiens
  misc_feature: GYAE6OF02GTFRB.27.23.C01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactggaacccgngatgacgttggtgcttataactttntctgttgtaccacgaggaccctaggcactgtacccaatcattcttatgatntcagtaactccggaccccgtgggtttcngactcgtcttctatcggactacgtaagtcctcgtcctaaccgacgggccctcccgttagacctacgttcccgttcccggggaccttaccgacggtcccgtgggaacgggtaacggacggtacgtaggttaacgttttaagtttacggtttacggttaacgtttacttaaacgttaacgttaaaaccccgtaacctaaggttacggtaacccttaacggggttttcgggggttaaccggttttccggggaacggggtacgggaaacccggtcggtaccgttcgttaaccccggttaccggtacggtaaccggtaacccgggtacccggtaaagggtccccgtccccggttacccccggttacgggttaccctaccccgttttaccggtccccgggttttacccccacccccggtttacccgg

SEQ ID NO: 274828 - DNA, 559 bp, Homo sapiens
  misc_feature: GYAE6OF02JS7RE.27.23.C01.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (368)..(368): a, c, t, g, unknown or other
  misc_feature (368)..(368): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaacccngatgacgttggtgcttataactttntctgttggtaccgacaggacccaggcactgtcccaaactcattctttatgatgtcagtaatcggccccaggggtttctgatcgcttctatgctcagtctgcctacacgcctcccngaccatctccgggctccagcctgaggacgaggctgtattattattgtagttcatatacacctagtgactacgttgggtcgttcgggcggagggaccgaggcttgacccgttccgtacggttcgacgtacccgaggccttacgaccccccgttcggtaccgaccttccgtaccggttccccgtaccctcccg

SEQ ID NO: 274829 - DNA, 979 bp, Homo sapiens
  misc_feature: GYAE6OF02I2424.27.23.C01.1.454.CMB.1.raw
  modified_base (250)..(250): a, c, t, g, unknown or other
  misc_feature (250)..(250): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcactagggtcctgggcccagtctgccctgactcagcctgcctccgtgtcgtgggtctccgtggactacggtcgatccaccgtattccgtccgtgacctacgtacgggaacccccnggtaactcggtacggtttcggcgttacttaacgtaaccgttttcgtcttggtttaccggtacccgtacgtacgggtaccccaggtacctacgttaccggtacccccttaaacgtccctaggttttaccccgtttaagtacggttaccgttacggttaaccgttaaacggttaacccggtttacccgggacccccccggtttaaaggggggttttcccttaacgggtaccgttttacccggtaccgttttaccggttaacggttccgggttaacccgttaacccgtttaacgggttaccttaccgggttaaccccgttaaccggtaccccgggttaaccccgtttacccgtttcccggtaaacccgttaccggtttacccgggtccccggttaacgttccccgggtaaaccgttttcccgggtaacggggttaacccggggttaaccggtaccggttaccgttaccggtttaaacgtttaacggttttacccggttagggttttaaaccgttccgttaaccgttaaacggttaaccccgttaaacgtaggttacccggttaacgttaacgggtttccggttaaccggggttccgtaacggggttacgtaccggacgttaccggttaaccgtccggtacgtacgggttcgaaccggtaccgtacggttccgaccggttacccgtcggttaacgttcccgtacgtttaccggtacccccgttagttacccgg

SEQ ID NO: 274830 - DNA, 680 bp, Homo sapiens
  misc_feature: GYAE6OF02JYVT6.27.23.C01.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcaggcacgagggtcctgggcccagtctgccctgactcagcctgcctccgtgtcgtggtctcctggacagtcgatcacatctccngcacgtggaacccngatgacgttgtgcttataacttntcgtgttcggtaccgacgacggacccaggctacgtccgtaccccaaactcttactttcttatgattgtacgtaacgtaacgtcccgggtccccgttaggggtttctaggtacgttccgtcttacgttagtcggtacctaccgtaacgttccgtacgtaccctaacgtacccggtccctttacccgacgttacccgtaccgttcccgtcccgggtacctcccgacgtcccgtagtacggacgtcgtctaagtactttattacgttgttagtacactaacgtacaacgtagtacgtacgttacggttagggtacggttcgggacggtacggccggtaggtcccgtacgtacccgtagtacgtccgacggacccgtagtcccgccgtcccgtacggtacctaccgtccggtacccgttccctcccgtaccg

SEQ ID NO: 274831 - DNA, 727 bp, Homo sapiens
  misc_feature: GYAE6OF02IXUXI.27.23.C01.1.454.CMB.1.raw
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataactttntctgttggtaccgacaggaccaggctactcgtacccaaactctatttctttangatgtacagtaactccggccccgtagggtttctgattcgtcttcgtagtcggtctacctaagtcgtacgaccctaacgtaccggcccttacccgtacgaaccctacgtccgtcccgggtccttaccgacgtcccgtaggaacgggacggtaggtcttacggtaatttacgtttacgttgttaacgtttacctaagttaaccttaaaccgaaccgtagttacgaaccgttaacggtttcggggttacggttccggggtacgggtaacggggtaccgtaacgggtacccgtacggtaaccccgttccggttaaggttcccggaaccggtacccgtaaagggtccccttacccggtcccccggtttacggtccccgtaaccgtttccccggtttaccgttcccccggtaaccccttcccgg

SEQ ID NO: 274832 - DNA, 710 bp, Homo sapiens
  misc_feature: GYAE6OF02HOOTS.27.23.C01.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtgcttataactttntctgttggtaccgacacggacccaggcactcgtaccccaaactctattctttatgatgtacagtaactccggccccgtagggtttctgatcgtcttctatcggctccaagtctcgaccctacaccggtccctcccgtacgaccctactccgtcccgggtcctaccgacgtcccgtaggacgggtaaccggtacgggtcgttagttaactttaagtttacgttacggtttaacgtttccgaatttaactaacctaaaccgtaggtacgtaaccgttacgtttagggtaacgttcgggttaccggggaccgggaacggggtacccaagggtccgttacggtaccccggtttccggtaacgggtccgaaccggtaccccggtaacgggtcccgttcccggtccccccgttcgggtaccctacccggtttccgttacccggttccccccgtacccccg

SEQ ID NO: 274833 - DNA, 706 bp, Homo sapiens
  misc_feature: GYAE6OF02I4NQ4.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcactcggaacccgcgatgacgttggcgtacttaataactttatcgttggttcggtaccacgacggacccgaggccacgtcgacccaactctatttacttagatatgtacagtaacgtcccggtaccccgtgggtttactgtactcgtcttcgtatcggtacctacctaagtctacgaccctacgaccgtccctacctacgacctacgttccgaccgggtcctacccgacgtccgtcggaacggacggacgtcgtagttacttattagttaggttagtactatactaactaaccgtagtacgtaacgttacgggtttaggtacggttacggggacggtacgggtaaccgtacggtccgtaacgggtacccgttaccgttaacgggtacctaaccgggacccgtaacgggtccctaccccggtacccccgttaccgggttacccttacccggttaccgtttacccccgttacccccgtaccccgttacccg

SEQ ID NO: 274834 - DNA, 674 bp, Homo sapiens
  misc_feature: GYAE6OF02GYH2Z.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatgacgttggtncttataactttntcttgttggtaccgacacggacccaggcacgtcgtaccccaaactctatttctttaatgagttgtacctaaggtaacgtccgggtcccccgtaggggtttctgtacgtcgtcctttctagtcggtccttaccgtaagtcctcggtaccctaccgaccgggtccccttaccctacgaaccctacgttccgtcccgggactcccgacgtcctggacggaccggagtctagtattattattgtacgttcattaactacaactgtacgactcgtttagggtcggttcggaccggagggtacccgtggtacctcggtaccccggtacgttacggaccgtacggaaccccggaaggtcccgtaccggtccccccgttagggcccttaccgttcccgtacccggttcccccgtaccccttacccg

SEQ ID NO: 274835 - DNA, 766 bp, Homo sapiens
  misc_feature: GYAE6OF02GTJ3U.27.23.C01.1.454.CMB.1.raw
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgcttaataacttttntctgttcggtaccgacacggacccaggcactgtaccccaaactcattctttatgatgtctagtaactccggcccccgtagggtttctggtactcgtcttctagtcggtcctaccgaagttcctacggacccttacgtacccgggtccccttaccccgtacgacccctaacgttccccggtacccggggcccttacccgaccggtcccgttagggaacgggaaccggacgggtaccgttaggttaacttttaacgttagttttaggtttaacgtttactaattaacctaacctaaacccgtaaggtaccgtaacgttaaccggtttggggttacgtttcccggggacgggtaacggggaacccgtacgggtaccgttacgggaccccggttaccgttacgggtaccgaaccgggtaaccccgtaagggtccccgtacccgtccccccgtttacgggtaccctacccgtttacccgtttcccggttaccccccgtaccccttacccccg

SEQ ID NO: 274836 - DNA, 832 bp, Homo sapiens
  misc_feature: GYAE6OF02H4M22.27.23.C01.1.454.CMB.1.raw
  modified_base (328)..(328): a, c, t, g, unknown or other
  misc_feature (328)..(328): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctggttctctggacagtcgatcaccatctcctgcactcggaacccgcgatcgacgttgggtcgtactttaattaacttttatcgttggttacggtaccgacgacggacccaggctacgtcgtaccccaaatctactttctttangtatgtactaacgttaacgtcccggtacccccggttaggggtttctagtacgttccgtacttcgttagtcggtcctaccgtaagttctacgtcccttaaccgacccggtccccttacccgtacgtaccctaccgtccggtaccccgggtccttacccgacggtcccgttagggaacgggtaccggacggtcttagttaactttatttacgttagttacgtttacaagttaactaacctaacgaacgttacgtaaccgttacggtttcggggttacgggttaccgggacggggtaacggggtaccgtaacgggcccgttaacgggtaccccgttaccggtaccgggttacccgaacccgggttaaccccggtaacgggtacccccgttacccccgggttacccccccgggtttacccgggttaacccctttacccccgggttttacccccggtttacccccgggtttttaccccccccccggaccccggttttaacccccccggg

SEQ ID NO: 274837 - DNA, 646 bp, Homo sapiens
  misc_feature: GYAE6OF02FLDBQ.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggccactcgtacccccaaactctatttctttatgatgtcaagtaactccggcccccgtaggggtttctgtactccgtcttcgtatcggtcctaccaagtcctcgaccctaacgaccggtccctccctacgaccctacgtccgtcccggcctccacgccgtaggacggacgaggctgtatttattagtttgttaagttctaatactaactaacctaggtactacgtacgtttggggtacggttcgggacgggacgggacctagggtcctacggtacccgtccgtaggtccgaacggtcccgaacggtccgtccggtcccccgtcggttccctaccgttccgttcccggttcccccgtacccctcccg

SEQ ID NO: 274838 - DNA, 644 bp, Homo sapiens
  misc_feature: GYAE6OF02HUN0L.27.23.C01.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggacccngatcgacgttggtncttaataactttatcttgttcggtaccgacacggacccaggcactcgtaccccaaactctatttctttatgtatgtctaagtaacgtcccggccccgtagggtttctgactcgtcttctagtcggtcttacgaacgttctcgtaccctacgaccgcccttccctacgaacctacgtccgtccgggtcctccgacgtccgtaggacggacgaggtctagtatttattagttagttagttacattaacaaccaacgtagtacgtacgttacggtttgggtacgttccggggacgggtacgggaccgtaggccgttacgaccgttccggtagtaccgacggacccgaggtcccttcccggccccgttcggtcctaccttccgttcccgttccccggccctcccgg

SEQ ID NO: 274839 - DNA, 727 bp, Homo sapiens
  misc_feature: GYAE6OF02ITUHH.27.23.C01.1.454.CMB.1.raw
  modified_base (230)..(230): a, c, t, g, unknown or other
  misc_feature (230)..(230): n is a, c, g, or t
  modified_base (270)..(270): a, c, t, g, unknown or other
  misc_feature (270)..(270): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccganacggaccccaggccactcgtaccccaaactctatttctttatgtatgtcagtactccggaccccgtaggggtttctgtactcgtcttctatcggtcctaccaacgtctacgtaccctacgaccggtccctcccgtacgaccctacgtcccgtcccgggtaccttcccgacgtcccgtaggaacgggaccggtacggtcgttagtaacttttagtttacgtttaggttaacgtttactaacttaacttaaccgaaaccgtaggttacgaaaccgtttacgggtttacggggttcgggttaccggggaccgggtaacggggtaacccgtagggtccgtaccggtacccggttaccgttaacgggtaccgaaccggaccccgtaacgggtcccgttccggtaccccccgttcggttaccctaccgtttcccgttacccgtttacccccacccgttacccg

SEQ ID NO: 274840 - DNA, 688 bp, Homo sapiens
  misc_feature: GYAE6OF02HW25E.27.23.C01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (405)..(405): a, c, t, g, unknown or other
  misc_feature (405)..(405): n is a, c, g, or t
  modified_base (677)..(677): a, c, t, g, unknown or other
  misc_feature (677)..(677): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtcctgccctgactcagcctgcctccgtgtctgggtctcctggacagtcgatcaccatcctcctgcactggaacccgngatgacgttggtnctttataactttntctgttcgtaccganacggaccaggcnctcgtccccaactcattctttatgatgctagtactccggccccgtagggttctgtactcgtcttctacgtcggtcctaccgaacgttctcggaccctaaccgtaccggtcccttacccgngtaaccctactccggtcccgggtcctccgtacgtccgtcggtaacggacgaggtcttaggtaactttacttagttgttacgtttactaacgttaacttaaccaaccgtaggtacgtaacgttacgggttacggggtttacggttaccgggtacgggtaacgggtacccgtagggaccgtaccggttacccgtaccggtaccgggtacgtaccggacccgtacgggtccttcccggccccgttacggtcctacccttccgtccgttacccccncccgttacccg

SEQ ID NO: 274841 - DNA, 660 bp, Homo sapiens
  misc_feature: GYAE6OF02H6I17.27.23.C01.1.454.CMB.1.raw
  modified_base (230)..(230): a, c, t, g, unknown or other
  misc_feature (230)..(230): n is a, c, g, or t
  modified_base (436)..(436): a, c, t, g, unknown or other
  misc_feature (436)..(436): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacacggacccaggcactcgtaccccaaatctattctttatgtatgtcagtaactccggtccccgtagggtttcagtatcgtcttctagtcggtctacctagtctcgcctacgaccggtccctcctacgtacctactccgtccggcctccgacgtccgtaggaggacgnggtcgtagtatttagttattggttagttacaagttaactaacaacgtagtacgtactaacggtttgggtacggttcgggacgggtacgggtaaccgacggtccgtacggtacccgtaccgttacgggtaccgaaccggtacccggtaacgggtcccgttacccggccccccgttacgggtacccgtacccttcccgtttcccgttacccccaccccgttacccg

SEQ ID NO: 274842 - DNA, 864 bp, Homo sapiens
  misc_feature: GYAE6OF02HYL0Q.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngtacttaataactttatctgttggtaaccgacgacggacccaggacacgtcgtacccccaaactcatttactttaatagtatagtacaagttaacgtccggtacccccgtaggggttttctagtaactcgtacgtttactacgtacggccttaccgtaaacgttcgtacgtaccccttaaacgaccgggtacccttaccccgttacgaaccctaacgttcccgtaccccggggtaccttacccgacggtacccgttacggggaacgggtaaacgggtacgggtaccgttagggtaaacttttaaacgtttaaacgttttacggttaacggttttaaccgtaaactttaaacgttaaacccgaaaaccgtaacggttacggtaaacccgttaacgggttttacgggggttacggtttaccgggggaaccgggggtaaccgggtaacccggtaacgggtacccgttacgggtaaccccggttaccggttaacggggtacccgtaaacgggttacccccggaaacgggttcccgttaaccccgggccccccccgtttaacgggtacccgttaacccgttacccggtttaccccggtttaccccccggtaccccgttacccccgg

SEQ ID NO: 274843 - DNA, 681 bp, Homo sapiens
  misc_feature: GYAE6OF02HE0OL.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (340)..(340): a, c, t, g, unknown or other
  misc_feature (340)..(340): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttaataactttatctgttggtaccgacaggacccaggcactcgtccccaaactcatttctttatgatgtcagtaatccggcccctaggggtttcngtactcgtcttctagtcggtctaccgtaaagtcctcgtaccctaacgtaccgggccccttaccccgtacgaaccctaagttcccgttcccgggccgtttcccgacgtcccgtaggaacgggaaccggtaggtccgttagtaatttaactttagtttaggtttactttacgtattaactaaccaaacgagttacgaactacgtttgggttgttacgggtacggacgggaccgtacggcgttacggaccgttacccgtaggtaccgaacgacccggaacggtccgttacccgcccccggtcggtacctccgttccgttacccggttcccgtaccccgtacccg

SEQ ID NO: 274844 - DNA, 769 bp, Homo sapiens
  misc_feature: GYAE6OF02I14UX.27.23.C01.1.454.CMB.1.raw
  modified_base (246)..(246): a, c, t, g, unknown or other
  misc_feature (246)..(246): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaacccgcgatcgacgttggtnactttataactttatcttgtacggtaccgactacggacccaggcactcgtaccccaaactctatttctttatgtactgtctaagtaacgtcccgggtaccccgtaggggtttcctacgtacttccggtccttactacgtcggtacctaccgtaaggttcctcggaccctacgtaccgggtcccttcccgtacgtaaccctaccgtccggtttccccgggccttacccgaccggtcccgttacgggaccggggtaccggtacggtccgttaggttaaacttttaacgtttaagtttcggttaacggtttactaaacgttaactaaaccctaaaccgtacggtacgacgtttaccggtttggggttacggttaccgggggaccggtaacggggtaacccgtaggtacgttccggaacccgttcgttaccgggtaccgaccggtacccgtaacgggtccccttaccggtcccccgttccgggtacctaccccgttccgttacccggttcccccgtaccccgtcccg

SEQ ID NO: 274845 - DNA, 607 bp, Homo sapiens
  misc_feature: GYAE6OF02F9MRS.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttggtaccgacaggacccaggcactcgtccccaaactctattctttaatgatgtcagtaatccggccccgtagggtttctgatcgtcttctatcgctcaagtctgctacgacgtcctccctgaccatccgtccggctcgacgcctgaggacgaggctagattatattgtagtcattatacaacctagtcgaactagttgggtcgttacgggcgggtagggaccagggctacggtacccgtccgttaagggtccgaacggacccgtaacgggtcccttaccggcccccccgttacgggttcctaacccgtcccgtttacccggtttacccccaacccccgttacccg

SEQ ID NO: 274846 - DNA, 739 bp, Homo sapiens
  misc_feature: GYAE6OF02GGTLL.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggncttatactttatctgttgtaccgacaggacccaggcactcgtaccccaaactctattcttatgatgtcagtaactccggccccgtaggggtttctgtatcgtctttctagtcggtcctccgtaagtcctcgccctaccgaccggtccctaccctgaccctatcccgtccgggcctaccgacgtccgtggaacgggaccggacggtccttaggttaaacttttacgtttacgtttaggtttaacgtttcctaaacttaacttaaacccgtaaaccgtaaggttacgtaaccgttaacggttttcgggggttacgggtttccggggacggggtaacggggtaacccgtagggtaccggttccgggtacccgttacccggttacgggtacccgaacgggtacccccggtaagggtccccgtacccggtccccccggtttacgggtacccttaacccggtttcccgtttacccggttaccccccgtaccccgtttaccccg

SEQ ID NO: 274847 - DNA, 734 bp, Homo sapiens
  misc_feature: GYAE6OF02GC8SL.27.23.C01.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttggtgcttataacttntctgttcggacgtacacggaccaggcactcgtaccccaaactctacttctttagtgtatcgtcagtaactccgggcccccgtaggggttttctgtacttccgtactttctagtcggtcctccgaagttcgtcggtaccctaccgaccggtcccctacccgtacgtaccctacttcccgtcccgggtcctacccgacgtccgtacggtacggaccggaggtctaggtacttttaagttacgtttagttacgttacctaattaacgtaaacctaaccgtagtacgtacgttacggtttgggtacgttccggggacgggtacggggtaacctacgggtaccgttaccgggtacccgttacccgttaacgggtcccgtaaccggtacccggtaaccgggttcccgttaacccggtccccccggttaccggttccccgttaacccgtccgtttaccccgggtttaccccctacccccgttaccccg

SEQ ID NO: 274848 - DNA, 692 bp, Homo sapiens
  misc_feature: GYAE6OF02GZ40Q.27.23.C01.1.454.CMB.1.raw
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatgacgttggtgcttataactttntctgttggtaccgacacggaccaggcaccgtgtacccccaaactctatttctttatgtatgtcagtaactccggccccgtaggggtttctgactcgtcttcagttcggtcctaccgtaagttcctcgccctacgaccggtccctccctacgaccctacgtcccgtcccgggtcctcccgacggtcccgtagggaccggacgggacggtctagtattttacttagtttaggttacgttacaacttaactaaccaacgtacgtcgaaccgttacgtttggggtcgttaccggggcgggtaacgggtacccgtagggtccttacgggacccgttccggtaacggtccgaaccggtaccccggaaagggtcccgttacccggcccccgttaccggttacctacccggttcccgtttcccggttcccccgcccttacccgg

SEQ ID NO: 274849 - DNA, 807 bp, Homo sapiens
  misc_feature: GYAE6OF02H37QP.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatcacctatctccgtgcacgttacgggaaccccgcgtaatcggtacggtttgggtcgtaccttttaattaaacttttacttcgtttcgggtttacggtaacccggtacgaacgggtaccccgaagggtcctaaccgttaccggttacccccaaaacgttccttaacgttttccttttaagtacgtactttcggtaactaacggtttaaaccgtccccggggttaaccccccgtttaggggggttttctacggtaaccgttccggtaccttttaccgttaacgttcggtacccttaccgtaacggttctacggtaccctacggcccggttaccctcccgtacgtaccgtacgttcccggtaccgggtcctacgaccgtccgtagggaacgggtaccggtagggtccttaggttaactttaggttttagttacggttacgtttacaacgttaactaacgtaaaccgtgtacgtaccgttaggttgggtacggtcggacggggtacgtaccggcgtcgtcgtacgtcgttacggtacgacgtaccgtacggtccgtaccgcccgttcgttacctcgtttcccgtaccgttccctacccgtaccg

SEQ ID NO: 274850 - DNA, 674 bp, Homo sapiens
  misc_feature: GYAE6OF02HSTJ7.27.23.C01.1.454.CMB.1.raw
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaacccgngatgacgttggtgcttataactttntctgttggtacgacaggaccaggcactcgtaccccaaactcatttcttatgtatgtacagtaactccgggaccccgtaggggtttctggtactcgtcttctagtggctacctagtctcgtacctacaccggtcctcccgtagaccctacgtccgtcccgggtcctcccgacgcccgtaggaacgggacggtaaggcttaggtactttaagtttacgttagttacgtttactatttaacgaaacctaaaccgtaagtacgtaacgttacggtttgggtacggtttccgggacgggtacgggaccgtacggtacgtacggacccgttccgtacggtaccgaccggacccgtaagggtacctaccggtcccccgtacgggttcctaaccgttccgttaccgttcccccgacccttacccg

SEQ ID NO: 274851 - DNA, 745 bp, Homo sapiens
  misc_feature: GYAE6OF02HTP0J.27.23.C01.1.454.CMB.1.raw
  modified_base (229)..(229): a, c, t, g, unknown or other
  misc_feature (229)..(229): n is a, c, g, or t
  modified_base (355)..(355): a, c, t, g, unknown or other
  misc_feature (355)..(355): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatcgacgttggtgcttaataactttatcttggttcggtaccgacacggacccaggccacgtcgtacccccaaactcatttctttatgatgtcagttaactcccggcccccgtaggggttttccngtacgtccgtcttcgtaagtcggcctcctaacgtctcgacccttacgaccggtcccttcccgtacgaaccctacgttccgtcccgggccttcccgacggtccctacgggaacgggaccggaacgggtcgttacggtaatttaagtttaagtttaggttaacgtttactaagttaactaaccaaaccgtaggttacgtaaccgttaacggtttgggggttcggtttaccggggaccgggtaacggggtacccgacgggtccgttacgggtacccgttaccggttaacgggtacccgtaacgggtaccccgtaacgggtcccgttacccggtccccccgttacggtaccctaccgtttcccgttcccggtttcccccggccccttaccccgg

SEQ ID NO: 274852 - DNA, 730 bp, Homo sapiens
  misc_feature: GYAE6OF02JP9AO.27.23.C01.1.454.CMB.1.raw
  modified_base (185)..(185): a, c, t, g, unknown or other
  misc_feature (185)..(185): n is a, c, g, or t
  modified_base (249)..(249): a, c, t, g, unknown or other
  misc_feature (249)..(249): n is a, c, g, or t
  modified_base (311)..(311): a, c, t, g, unknown or other
  misc_feature (311)..(311): n is a, c, g, or t
tcagagcgtcgtctcacgaccggtgctcgatttagtacacgtgattagggagttggggggggtcgtcgaggaggcagcgctctcgggacgtctccaccatggcctgggctctgctattcctcaccctcctcactcagggcacagggtcctgggcccagtctgccctgactcagcctgcctccgtntctgggtctccgtggacacgtcgatcaccatctcctgacactgtaaccccggatcgacgttggncttaataacctttctgttgtacgtacacggtaccaggcactcgtacccaactcattcttatntatgtactagtacgtccggtaccccgttaggggtttcctagtacgttcccgtcttactacgtcggtaccgtaccgtaagttccgtacgtcctaccgtaaccggtccctttcccgacgtaaccctcgtcccggtacccgggtcctacccgaccgtaccgttcggaacgggtaccgtacggtcgtaggttacctttaaattcgtttaggtacgtttacgtactaacgtaacctaaccgtagttacgaccgttacgttgggttcgtaccgggtacggggtataccggtacgggtccgtacgggtaccccttacgggttacgtacccgggacccttaaccgggaacggtaccttccccggggaccccgttccggttacctaccccgttttcggtaccccggtttacccccacccgttaccccg

SEQ ID NO: 274853 - DNA, 685 bp, Homo sapiens
  misc_feature: GYAE6OF02GOHRF.27.23.C01.1.454.CMB.1.raw
  modified_base (238)..(238): a, c, t, g, unknown or other
  misc_feature (238)..(238): n is a, c, g, or t
  modified_base (381)..(381): a, c, t, g, unknown or other
  misc_feature (381)..(381): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatccaccatcctcctgcacgtcggaaccccgngagtgtacgttggtgtcttaattaactttatctgttcggtaccgacgacggaccagcactccgtaccccaaactctacgttctttatgtatgtactaagtacgtccggaccccggttagggtttctgtacgtcggttctactntcggctacacgtctcgctaccgccgtccctcctcaccacgttccgtcccggtcctaccgacgtcccgtggacggaccggtaaggtcgtacgttatttaactttcgtttagttacgtttacttaagtaacctaaccgtaaccgtacgtaacgtaccgttaacggtttgggttacgggttcgggacgggtaccgggaacgtcggtacgtccggtaacccgttccgtaggtaccgaaccgccggaacggtcccgtcccgtacccgtccggtacctcccggtaccttccgtacccctacccgtacccg

SEQ ID NO: 274854 - DNA, 721 bp, Homo sapiens
  misc_feature: GYAE6OF02I8VHO.27.23.C01.1.454.CMB.1.raw
  modified_base (240)..(240): a, c, t, g, unknown or other
  misc_feature (240)..(240): n is a, c, g, or t
  modified_base (705)..(705): a, c, t, g, unknown or other
  misc_feature (705)..(705): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcaggcacagggtcctgggcccagtctgccctgactcagcctgcctcgtgtctgggtctcctggacagtcgatcaccatcctcctgcactcggaaccctgatgacgttggngcttataactttatctgttcggtacacaggacccaggcactcgtccccaaactctacttctttatgtatgtactagtaactccggccccgtaggggttctgactcgtcttctagtcggctacgtaatccgtcgacccgtacgtaccggtccctccgtcgaaccctagtcccgtccggcctaccgacgtacccgtacggaacggggcgtaacggtcgtacgttatttagttacgttaggtttacgttctaagttaactaaccgtaaccacgggttactacgttaccggtttacgggtttacgggtttccggggacgggtaaccggggtacccggtagggtaacccgtcggggtaaccccgttacggtacggtaccgaaccgggtacccgtaacgggtacccgttcccggacccccgtttaccgggttaccgtaacccgtttcccggtttaacccggtttacccccncccccgttaaccccgg

SEQ ID NO: 274855 - DNA, 729 bp, Homo sapiens
  misc_feature: GYAE6OF02IDKUL.27.23.C01.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtgtcgtgggtctcctggacagtcgatcacntctcctgcactacgggaacccgntagtcgtacgttggtctactttaattaactttntcgttgttacgtaccgacgacggaccgagctacgtaccgtaaccctaactcttactttctttatgtactgtactaagtaccgtcccggtaccccggttaggttctagtactcgtacttacgtagtcgtactacgtacgtctaccgtacctaccgtaccgtccctccgtacgtacctcgtccggtccggtcctacgacgtaccggtaggaccggtacgtcggtacgttacgttaagtttacgttagttacgttacgttaacttaacgttaactaacctaacgtaacggttacgtaccggttacggtttcgggttaccgggttacgggaccgggtaacgggaaccgtacggtaccgtacggttacccgttacggtacgtaccgaacgaacccggtacggtcccgtaccccggtacccgttacgtacctaccgtttacccgttaccccgttacccctacccgtaccg

SEQ ID NO: 274856 - DNA, 623 bp, Homo sapiens
  misc_feature: GYAE6OF02HKIFW.27.23.C01.1.454.CMB.1.raw
  modified_base (230)..(230): a, c, t, g, unknown or other
  misc_feature (230)..(230): n is a, c, g, or t
  modified_base (343)..(343): a, c, t, g, unknown or other
  misc_feature (343)..(343): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttgtgcttataactttatctgttcggtaccgacaggacccaggcactcgtccccaaactcactttcttatgtatgtacagtaacgtccggccccgtaggggtttcngtactcgtcttctatggctccagtctcgcctacaccggtcctccgtcgaccatccgtccggctccacgtcctggacggacgaggctgtattattattgttacgttcaatacacaaccagtcgaacttacgttggggtgttaccggggacgggtacgggaccgaggtccgtaccgtaccggtccgttacggtaccggaccgtacccgaacgggtccctccggtaccccccgttcggtaccctaccgttcccttacccggtttcccccgtcccgttaccccg

SEQ ID NO: 274857 - DNA, 777 bp, Homo sapiens
  misc_feature: GYAE6OF02HP0YV.27.23.C01.1.454.CMB.1.raw
  modified_base (376)..(376): a, c, t, g, unknown or other
  misc_feature (376)..(376): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatctcctgcacgtcggaacccgcgatgacgttggtgtactttaattaacttttactcgttggttacggtaaccgtacgacggacccgaggacactcgtacccctaaactctattcttatgtatgactagtaacgtcccggcccgtagggttcagtactcgtcttntagtcgacctactagtctcgtaccctacgaccggtccctacccgtgaccctacgtccgtccggtcctaccgacgggtcctagggaacggtaccggaggtacttaggtaattttaaggtttacgttaaggtttacgtttaccgtaatttaaacctaacccgtaaaaccttaggttaacgtaacccggttaacggggttttaggggttaccgggtttaccgggggaaccgggggtaaacgggtaccccggtaggtacccgtttacgggtaacccgttaccggttacgggaaacccgtccgggaacccggttaaccggtcccggttacccccggtcccggttacccggtaccgtaccccggtttacccttacccccggtttaccccccgtacccccttacccgg

SEQ ID NO: 274858 - DNA, 807 bp, Homo sapiens
  misc_feature: GYAE6OF02H4AW4.27.23.C01.1.454.CMB.1.raw
  modified_base (159)..(159): a, c, t, g, unknown or other
  misc_feature (159)..(159): n is a, c, g, or t
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (705)..(705): a, c, t, g, unknown or other
  misc_feature (705)..(705): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgaggtcctcgggcccagtcncgccctgactcacgcctcgccctccgtgtcgtgggtcctccgtaggactagtcgatccaacctactcctcctgcctacgtaccgggaacccgngtatacggtacggtttgggtctactttaacttaaacttttntcgttggtttacggtaacccgacgaccggaaccccgaggtaccacgttccgtaaccccctaaaacttccttacttttaccttttaagtacgttaacgttcgtaacgtaacggtttaaccgtccccgggtacccccggtttagggggttttaccacggttacgtccgttacgtttacgttaaggttccggtacccttaccgtaacggttcctaccggtacctaccggtacccggtcccttacccgtacgaccctacgtcccggtccgggccctaccgaccggtcgtacgggaacggtacggtacgtcgtaagttactttaagtttagttacgttacgttactaacgttaactaaccgaaccgtagtacgaccgttaggttcggggttcgttaccgggacgggtaccgtaccgngtaccgtacgtaccgttcggtacgtccgaaccggtaccgtacggtcccgtccggccccgttggtaccctaccgttccgtcccgttacccccgaccttacccg

SEQ ID NO: 274859 - DNA, 770 bp, Homo sapiens
  misc_feature: GYAE6OF02G2RHO.27.23.C01.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (343)..(343): a, c, t, g, unknown or other
  misc_feature (343)..(343): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggtncttataactttatctgttggtaccgacacggacccaggcactcgtacccccaaactcattctttatgtatgtcagtaactccggccccgtagggtttcngactcgctttcagtcggtactaccgagttctcgacctaccgacggtccctcccgtacgacctagtcccgtaccgggtcctcccgaacgtcccgtaggacggaccggaggtaccttaggtaattttaacgttagtttacggttaaggtttacctaactttaacgtaaacctaaacccgtaaggttacgaaaccgtttaacccgggtttgggggtaccggttttaccgggggacggggtaacgggggtaacccgtaacgggtaccgttccgggtaaccccgtttacccgggttaacggttaacccggtaaccgggtacccccggtaaacggggtcccttaccccgggtacccccccggtttacgggtaccccttacccggtttacccggtttccccgggttttccccccccgtaccccgttacccccgg

SEQ ID NO: 274860 - DNA, 744 bp, Homo sapiens
  misc_feature: GYAE6OF02JNOD6.27.23.C01.1.454.CMB.1.raw
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcacgtcggaacccgngatgacgttggtcgctttaataactttntcgtgttcggtaccgacgacggaccctaggcctacgttacgtaccccctaaactctaactttcctttaatgtaacttcgtactaagttaacgtcccggtccccgtaaggggttttctgtactccgtcttcgtagtcggcctacctagtcctacgccctacgtaccggtcctccgtcgtaacctcgtccgtcccgggctcccgtacgccgttaggaacggaccgtaggtctaggttatttaacgttacgttagtacgtttactaagttaacctaaccgtaaccgtacgttagaaacccgtttacgggtttacggggttaccgttaccggggtacgggaaccgggtaccgtaacgggtcccgttacgggtaacccgttcggtaacggtaccggtaaccggacccggtaaggttccccggtacccgttcccccggtacgttcccgttaacccttccggttaccccggttacccctaaccccgttccgg

SEQ ID NO: 274861 - DNA, 779 bp, Homo sapiens
  misc_feature: GYAE6OF02HFPL9.27.23.C01.1.454.CMB.1.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtcctgggtctcctggacngtcgatcaccatcctcctgccactacggaaccccgcgatcgtacggttgtgacttaataacttntcttgtgtaccgacacggacctaggcactcgtacccaaactctattctttatgattcgtacgagtaactccggaccccgtagggtttctagtacgtacgtcctttacgtagttcggtacctaccgtaagttccgtacgtaccctaccgaccggtccctcccgtacgaacctaccgtccgtcccgggtacctaccgacgtccgtacgggtaacgggaacggtacgggtaccttaggttaaactttaagttttacgttacgggtttaactttaccgtaaacgttaaacgttaaacccgtaaaacccgtaggtacggtaaccgttaccgggttttaggggttaccggttaccggggtaaccggggtaacgggtaacccggtaggtaccgtacggttaccccggtaccgttacggtacccggtaaccgggaacccgttacgggtccctacccggtcccccggtacggttcccgtacccgtttacccgttcccggtttaaccccccacccggttacccg

SEQ ID NO: 274862 - DNA, 855 bp, Homo sapiens
  misc_feature: GYAE6OF02HPGN9.27.23.C01.1.454.CMB.1.raw
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacactctcctgcactcggaacccgngatgtacggttggtgacttataactttnttacgttggttacggtaaccgacaacggtaaccccaggcctaacgtcgtaccccaaaacttcctaactttctttaactgtattggtactaaggttaacgtcccgggacccccgttaaggggttttcctaggtactccggtacttaccgttaacgtcgggtacccttacccgtaaaggttccgtaccggtacccgtttaaccgacccggggttaccctaccccgttacgtaaccctaccgttaccgtccccggggtaccctacccgtaacggtacccgtaagggaacgggtaacccgggtaagggtaccgtttaacgggtaaagtttttaaacgttttaaggtttacggttaacggttttaacctaaagtttaaaccgtaaaccgtaaaacccggtaacgttaccgggtaaacttaccggttttaggggggttcgtttaccggggggacgggtaaccgggggtaacccgacgggtaccgttacggtacccggttacggttaaccggtaccgaaaccggcccgtaaacgggtcccttacccggtcccccgtacgggttcccaccgttcccgttaccgttaccccctacccgtaacccg

SEQ ID NO: 274863 - DNA, 699 bp, Homo sapiens
  misc_feature: GYAE6OF02ID065.27.23.C01.1.454.CMB.1.raw
  modified_base (394)..(394): a, c, t, g, unknown or other
  misc_feature (394)..(394): n is a, c, g, or t
  modified_base (449)..(449): a, c, t, g, unknown or other
  misc_feature (449)..(449): n is a, c, g, or t
tcagagcgtcgtctcacgaccggtgctcgatttagtacacgtgattagggattggggggggtctcaggaggcagcgctctcgggacgtctccaccatggcctgggctctgctattcctcacccctcctcactcagggcacagggtcctgggcccagtctgccctgactcagcctgcctccgtgtctgggtctccgtggacagtcgatcaccatctcctgcactcggaaccccgcgatgtacgttggtcgtctttaataactttatcttggttggtaccgacacggacccaggcactccgtacccaactctattcttatgtatgtctaagtaacgtccggacccccgtagggtttcctggtactcgtcttctagtcggtcctacctaacgtctcnccctacgacggccctcctcgacctactccgtcccggctcacgcctggacggacgnggtctgtacttattgttacggttacttacattaactaacaacgtagtacgaaccgttacgttacgggttcgttccggggacgggtacgggtaaccggtaggtacccggttacgtacccgggttacgtaaccgggttccgaaaccggtcccgtaaccgggtccgttaccccggtaccccccggtttccgggtacccttaaccccggtttccggtttaccccgtttcccccccgtacccctttaacccccgg

SEQ ID NO: 274864 - DNA, 672 bp, Homo sapiens
  misc_feature: GYAE6OF02GB8GB.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtaccccaactctattctttatgtatgtcaagtacgtccggccccgtagggtttctgatcgcttctagtgctcagtctgcctacgaccgtccctccctcgacctacgtccgtcccggtcctaccgacgtccgtacggtaacgggaccggtacggtcttagtactttaattagttagttaagttctaattaactaacaaccgtaggtcgtacgttacggtttggggttacgggttaccgggacgggacgggtaccgaggtaccgttacgacccggttccgtaacgggtacgaaccggtacccgaaccgggtccggtaccccggttcccccggttacggtacccgttaacccgttccgtttacccgttacccccttaccccgttacccg

SEQ ID NO: 274865 - DNA, 660 bp, Homo sapiens
  misc_feature: GYAE6OF02IZXDU.27.23.C01.1.454.CMB.1.raw
  modified_base (235)..(235): a, c, t, g, unknown or other
  misc_feature (235)..(235): n is a, c, g, or t
  modified_base (364)..(364): a, c, t, g, unknown or other
  misc_feature (364)..(364): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactcgggaaccccgngatcggacgtttgggtcgacttattaaaccttttatcgttggttcggtaccgacgacggacccaggcacctcgtaccccaaactctattctttatgtatgtcagtaacgtccggccccgtagggtttcngtatcgtcttctagtcggtctctacgtctcgccctacgaccgtccctccgtcgacctacgtccgtccgggtcctccgacgacccgtggaagggaccgtaggtccgtgttaactttattagtttcgttagtttactaattaacgtaccaacgtagtacgtactacggtttgggtggttcgggacgggtaacgggacctaggccgtacggtacccgtacgtacggtacgacggtacccgacggtcctcccgtccccgtccggtcctacccgtcgttcccgttaccccctccgtacccg

SEQ ID NO: 274866 - DNA, 773 bp, Homo sapiens
  misc_feature: GYAE6OF02FHKWO.27.23.C01.1.454.CMB.1.raw
  modified_base (238)..(238): a, c, t, g, unknown or other
  misc_feature (238)..(238): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcgaggcacagggtcctgggcccagtctcgccctgactcagcctgcctccgtgtcgtgggtcctccgtggacagtcgatcaccatcctcctgccacgtcggaaccccgngatggtacgttggctactttaattaacctttatcttgttcggtaccgacgacggacccaggcctacgtaccgtaccccaaactctacgtttcttactagtactgtactaagtaacgtcccgggtaccccgttaggggttttctacgtacttccggtctttacgtacgttcggtacccttaccgtaacgttccgtaccgtacccgtaaccgtacccggtccccttaccccgtaccggtacccttaccgttcccgggtcccgggtacctacccggacgtacccggttagggaaccgggtaaccggtacgggtaccgttacggtttaactttaagtttacgtttaggttaacgttactaacgttaactaacctaacgtacgttacgtaccgttacggtttcggggttacgggttacgggacgggtacgggtaaccgcggtacgtacgtacccggtacgtacggtccaaccggtaccgaacggtccgtacccgtccccgttcggtaccttaccgtcgtccccgttcccgtccctacccg

SEQ ID NO: 274867 - DNA, 686 bp, Homo sapiens
  misc_feature: GYAE6OF02GRW48.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattggggggggtctcaggacccggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgctttataactttatctgttcggtaccgacaggacccaggcactcgtccccaaactctattcttatgatgtcagtaactccggccccgtagggtttctgactcgtcttctatggctcagtctcgcctacgaccggtcctccctgacctatccgtccggtctccgacgtccgtaggacgggacggaggtctacgtaatttagtttagttgttaacgttctaagttaactaaccgtaaaccgtaggttacgtaaccgtaacggtttcggggtacggtttccgggacggggtaaccgggtaccgaacgggtcgtaccggtacccggttccgttaacggtccggtaaccggaccccggtaaacgggtcccgttacccggtccccccgttacgggttccctaacccggttcccgtttcccggttaccccccgtcccgttaccccgg

SEQ ID NO: 274868 - DNA, 748 bp, Homo sapiens
  misc_feature: GYAE6OF02GVS4W.27.23.C01.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (341)..(341): a, c, t, g, unknown or other
  misc_feature (341)..(341): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcacatctcctgcactggaacccgngatgacgttgngcttataactttatctgttggtaccgacaggacccaggcactcgtaccccaaactctatttctttatgtatgtcagtaactccggccccgtaggggtttcngtactcgtacttctatggctacaagtctacgcctacgaccggtcccttccctgacctacgtccgtcccgggctccgacgcccttggaacggacggaggtccttaggtaactttagtttactttaggttaacgtttactaacgttaactaacctaaacccgtaaggttacgaacgtttaccggttttcgggggtttacggttttaccgggggaccggggttaacggggtaacccggtacgggtaccgttaccgggtaacccggtttcccggttaaccgggtaccgtaaccgggtacccccggtaaaggggtcccgtttaaccccgggtcccccccgttaccggggtttaccctaaccccggttttcccggtttccccggtttcccccccggtccccttttacccccgg

SEQ ID NO: 274869 - DNA, 827 bp, Homo sapiens
  misc_feature: GYAE6OF02F9AMQ.27.23.C01.1.454.CMB.1.raw
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcactcggaacccggatggacgttggntctttaataactttntctgttggtaccgacacggaccaggcactcgtaccccaaactctatttactttatgtattcgtactaaggtaacgtccgggccccgtaggggtttctagtactcgtcttcgtagtcggtctaccgtaagtcctacgtaccctacgaccggtcccttcccgtacgaaccctacgttcccgtccggggtccctccgaccggtcccgtagggtaaccgggacgggtacgggtaccgttagggttaaactttaacgtttacgttttacggttaacgtttaccgtaatttaaacctaaaccgtaaaccgttaacggttacgttaaaccgttaaccgggttttcgggggttaccggtttaccggggtaacgggggtaaccgggtaacccggtacggggttaccgttaaccggaacccgggtttaccggttaacggtacccggtaacccgggtaaacccgtaaacggggtcccccgttaccccgggttaccccccggttaccccgggttaaccgttaccccggtttacccgttttacccccggttacccccccgttaacccccgttacccccggg

SEQ ID NO: 274870 - DNA, 723 bp, Homo sapiens
  misc_feature: GYAE6OF02JBCPK.27.23.C01.1.454.CMB.1.raw
  modified_base (348)..(348): a, c, t, g, unknown or other
  misc_feature (348)..(348): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgtcttaataactttatcttgttcggtaccgacacggacccaggcactcgtaccccaactctatttcttatgattgtcagtactccggtaccccgtaggggtttccngtactcgtcttctagtcgactaccgtaagtcgtcgtacctaccgacggtccctccgtacgacctactccgtccgggctcccgacgtcccgtaggacggacgacggtcgtaggttaatttagttacgtttaggttacgtttactaagttaaccttaaccgaaccgtaaggttacgtaaccgttacggtttacggggtttacggttaccggggtaccggggaacgggtacccgacggggttaccgtccgggtaacccggtttccggtaacggtaccgaacccgggtaacccgtaacgggtacccgttccccggtacccccggttccggtacccgttacccttccgtttacccgttacccccccgtacccttaccccg

SEQ ID NO: 274871 - DNA, 783 bp, Homo sapiens
  misc_feature: GYAE6OF02HH92E.27.23.C01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccattctcctgcctactcgggaaccccgngattcggtacggttggtcgtactttaataacttttatcgttggttacggtaaccgacgacggacccgaggaccactcgtacccccaaattcttaatttctttagtagtagttcgtactaagtaacgtcccgggtaccccggttaggggtttctggtacttccgtctttactagtcgtacctcctaacgtcctcgtacccctaacggtacccggtccccttacccgtacgaccctaccgttcccggtcccgggtaccttacccggtaccgtcccggtagggacgggtaaccgggtaggtcgttaacgttagttttaacgtttagtttacggtttacgtttactaacttaaacctaaccgtaaaccgtacggttacgtacgttacggtttcggggttacggttcggggtacgggtacgggtaccggtacggtccgttacggtacccggtacggtacggtaccgtaccggtaccggtaccgggtcccgtaccccgtcccgtaccgtacccgttccgttacccgttcccgttacccctccccgttacccg

SEQ ID NO: 274872 - DNA, 643 bp, Homo sapiens
  misc_feature: GYAE6OF02GB6X6.27.23.C01.1.454.CMB.1.raw
  modified_base (229)..(229): a, c, t, g, unknown or other
  misc_feature (229)..(229): n is a, c, g, or t
  modified_base (552)..(552): a, c, t, g, unknown or other
  misc_feature (552)..(552): n is a, c, g, or t
  modified_base (633)..(633): a, c, t, g, unknown or other
  misc_feature (633)..(633): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaacccncgatgacggttggtgcttaataactttatctgttcggtaccgacaacggacccaggccactcgtaccccaaactctactttctttatgtatgtacgtagtaacgtccggtcccccgtagggtttctagacgttcgtcttacgtagtcggcctactaacgtctcgtccctacgaccggtcctccctacgaacctacttccgtcccgggtctacccgtacgtccgtacggacggtacgacggtctagtaattattattcgttagtacgtaataactaacgactagtacgtactaggttggttaggttcgggacgggacgggaccnggtcgtcgtaccgttcgtaacggtcaacggtacccgaacggtcctcgtccccgtcggtcctaccgttctcccggttccccncccgtacccg

SEQ ID NO: 274873 - DNA, 775 bp, Homo sapiens
  misc_feature: GYAE6OF02JX6HM.27.23.C01.1.454.CMB.1.raw
  modified_base (234)..(234): a, c, t, g, unknown or other
  misc_feature (234)..(234): n is a, c, g, or t
  modified_base (562)..(562): a, c, t, g, unknown or other
  misc_feature (562)..(562): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcaggcacagggtcctgggcccagtctgccctgactcagcctgcctccgtgtctgggtcctcctggaccagtcgatcacctatcctcctgcactcgggaaccccngatcggacggttttggtcgactttaacttaaacttttgttccgttcggtttacggtaaccggaacgtacgggaaccccaagggcctaaccgttccggttaccccccaaaacgttctaactttcctttaagtcagttctacgaagttaacgtcccggccccgttaggggtttctaggactccgtacttgtactcggcttaccgaacttcgtacgcctaacgccggtcctccctcaccgtaccttccggtccgggtccaccgtacgccggttaggccggacgacggtccttagttagtttaactagtttagtacgttttagaactttaanaccgaaacgaggttagaacctttacggggttcggttacgggtttaccgggacgggaccgggtaaccgacggtacggttacccgtaccgttaccggtacggttacccggaccggaaaccccgggttagtcccggttacccgttacccccggttacgggttaccccttcggtttaccccgttcccgggttttacccccccgacccctttcccggg

SEQ ID NO: 274874 - DNA, 685 bp, Homo sapiens
  misc_feature: GYAE6OF02JJXUB.27.23.C01.1.454.CMB.1.raw
tcagagcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgcgatgacgttggtgcttataactttatctgttgtaccgacaggacccaggcactcgtcccccaactcattctttatgatgtcagtaatccggcccctaggggtttctgtactcgtccttctatcggctcctaagtcttgcccttaccaccggtccctcccctagaccctacgttccgtcccgggcttcccacgtcccttggacgggtacgagggtctagtaactttaattagtttcggttacgtttactaacttactaaccctaaacccgtagttcgaaccgttaacgtttcggggttacggtttccgggaccgggtacgggtaacccgaggtccgtacgtacccggttccgtaccgggtcgtaaccggaccctaaacggggtcccttccggtaccccccgtcgggttacccttacccgttacccgttccggtttacccccgtcccccttacccg

SEQ ID NO: 274875 - DNA, 775 bp, Homo sapiens
  misc_feature: GYAE6OF02H97Z5.27.23.C01.1.454.CMB.1.raw
  modified_base (664)..(664): a, c, t, g, unknown or other
  misc_feature (664)..(664): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctctgccactcggaaccgcgatcggacgttggtacgtcttaattaaacttttatcgttgttacggtaaccgacgacggaaccgaggacactacgtaccctaaactacttattcttttaatcggtagttcgtacgtacggttaaccgtcccgggtacccccggttaggggttttaccgtagtacttccggtaccttttacgtaggttacggtaccttaccgtaaacgttccgtacgacccgttaacgacccggtccctacccgtaccgaacctacgtcccggtcccgggtcctacccggtagcccgtagggaaccggaacgggtacggtactaggttaactttagtttagttcgggtttaactaccgtaaattaccttaactaaacccggttagtacggtaaccgttcgggtttcggggttacgggttaccgggtcgggggaaacgttaccggnggtacccgttacggtaccgttacggtacggtacgcggttaacccggaaggtcccgtcccggtaccccggtttgacccttaccgttccggtaccccgttcccgcccctacgg

SEQ ID NO: 274876 - DNA, 700 bp, Homo sapiens
  misc_feature: GYAE6OF02G58WP.27.23.C01.1.454.CMB.1.raw
  modified_base (259)..(259): a, c, t, g, unknown or other
  misc_feature (259)..(259): n is a, c, g, or t
  modified_base (317)..(317): a, c, t, g, unknown or other
  misc_feature (317)..(317): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaacccgcgatgacgttggtgcttaataactttntcttgttcggtaccgacgaggacccaggccacgtcgtaccccaaactctatttcttangtatgtacagtaactcccggccccgtaggggtttctagtactcgtctttcgtagttcggtcctaccgtaagttcgtacgtaccctaccgaccggtccctcccgtacgacctacgtcccggtcccgggcctacccgcgtccgtagggaccgggtacgacggtacttagtaacttttagttacgtttaggttacttactaacgttaacctaaccgtaacgtaaggtcgtaacgttacgggtttggggttacggttacggggacggtacgggtaccgtacggtccgtacgggtacccgttacgtacggtccgaacggtacccgaggtcccgtcccggtaccccgttacggtcctacccgtccttaccccgttcccctaccctaccg

SEQ ID NO: 274877 - DNA, 765 bp, Homo sapiens
  misc_feature: GYAE6OF02H9GAH.27.23.C01.1.454.CMB.1.raw
  modified_base (239)..(239): a, c, t, g, unknown or other
  misc_feature (239)..(239): n is a, c, g, or t
  modified_base (270)..(270): a, c, t, g, unknown or other
  misc_feature (270)..(270): n is a, c, g, or t
  modified_base (338)..(338): a, c, t, g, unknown or other
  misc_feature (338)..(338): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctctcactcagggcacgagggtcctgggcccagtctcgccctgactcagcctgcctccgtgtcgtgggtcctccgtggacaggtcgatccaccattcctctagcacgtcggaacccgngatgtacggttggtctacttaataacgtttntccgttgttcggaaccgacggacggacccaggcctactcgtaacccctaatctaatttcttatacggntacgtactaagttaaccgcccgtaccccgggttagggtttcaggttctacggtctttacgtagttccggtacctacgtaacgttcctcgtaacccgttaccggacccgttccctccgtttaaccgacgtacttccggtaccccgggtctacggtcttacccggagggaaccggttacggacgtacgtttaaggtttaacgtttaaagtttctttaaccggttagttaacttaacggttaccttaaaacgacgtaacgtacgtaccgttaacgggttttcgggaggtttaccggaacggtacgggtaacgtacgtaccgtaccggttaccgtaccgtacggttaccaaccggccgtaaggtcccgttacccggtacccgttaccgaccgttaacccgttcggttcccttaccccggacctttacccgg

SEQ ID NO: 274878 - DNA, 718 bp, Homo sapiens
  misc_feature: GYAE6OF02FZD79.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccngatgacgttggngcttataacttntctgttcggtaccgacacggaccaggcactcgtaccccaactctatttactttatgtattcgtactacgtaacgtcccggccccgtaggggtttcctaggtacttccgtctttacgtacgtcggtctaccgtaagttctacgtaccctaccgaccggttccctcccgtacgacccgtaacgttcccggtaccggtcctacccgaagtcccgagggaacgggtacgacggtctagtaatttagttagtttcgttaagttcctaacttaactaaccgaaccgtagttacgtaaccgtacgtttcggggtcggtttaccgggacgggtaccgggacgtagggtccgttacgggtacccgttacgtacggtaccgacggtacccggaacggttcccgtacccggtcccccggtccggtaccgttaacccgttcccgttacccgggttccccctaccccgttacccgg

SEQ ID NO: 274879 - DNA, 676 bp, Homo sapiens
  misc_feature: GYAE6OF02JD8BV.27.23.C01.1.454.CMB.1.raw
  modified_base (256)..(256): a, c, t, g, unknown or other
  misc_feature (256)..(256): n is a, c, g, or t
  modified_base (341)..(341): a, c, t, g, unknown or other
  misc_feature (341)..(341): n is a, c, g, or t
  modified_base (393)..(393): a, c, t, g, unknown or other
  misc_feature (393)..(393): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttntctgttggtaccgacaggacccaggcactgtacccccaaactcattctttaatgtatgtcagtaatccggcccctaggggtttcngatcgtcttctagtgctccaagtcctgccctacgaccggcctccctgacccntccgtccgggctcccacgcctggacgggacgcggtctgtaatttattattgttacgttcaattactacaacctagtcgtaacgtacgtttggggttcgttaccgggcggggtaacgggtacccgtagggtcccgttacgggtaccccgttcgttaacggggtaccctaacgggtaacccccgtaacggggtcccgttcccgggtaccccccccggtttaccgggtaccgttaaccccgtttccggtttacccccggttacccccttacccccgtttaccccgg

SEQ ID NO: 274880 - DNA, 768 bp, Homo sapiens
  misc_feature: GYAE6OF02JXHIB.27.23.C01.1.454.CMB.1.raw
  modified_base (146)..(146): a, c, t, g, unknown or other
  misc_feature (146)..(146): n is a, c, g, or t
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
tcagagcgtcgtctcacgaccggtgctcgatttagtacacgtgattagggagttggggggggttcgtcgaggaggcagcgctcccgggacgtctccaccatggcctgggctctgcttattcctcaccctcctcactcagggcacgngggtcctgggcccagtctcgccctgactcagcctgcctccgtgctggtctcctggacngtcatcacntcncngcacgngaccngatcggacgttggtcntttaatacttgtcctgtggtccgacaggaccaggcacgtcgtcccgaactctacttcgtttaancgtaatcgtanagtaacgtaccgtccccggtaggtttcgtacgngtcgtcttacgtacgtggtccgtactaaccggttctcgtaaccgtccgtaaccggttcctacccctacgtacctaacccggttccgtccgggtaacctccgtaccgtccgttacggtacgggaccgggtacggtacgtacgttacgtttaacgtttaacgttacgtttaacggtttacctaactttaaccggttaaaaccaaaccgttaggtaaccgtacgtaaccgggtttcggggttacggtttaccggggtaccgggtacgggtaaccgtagggtaaccgaccggttaccgttaccgggtaccgttacggacccgggtccggtaaacggttccgtaaccccgttccccggaccggttaccctaccggttccgtttaccccgttacccgttaacccccgtcccgtaaacccgg

SEQ ID NO: 274881 - DNA, 689 bp, Homo sapiens
  misc_feature: GYAE6OF02G2A8J.27.23.C01.1.454.CMB.1.raw
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaacccgngatgacgttggtgcttataactttntcttgttcggtaccgacacggacccaggcactcgtaccccaaactctatttctttangtatgtcagtaacgtccggccccgtaggggtttctgactcgtcttctatcggtactccgaagtctcggccctaacgaccggtccctccctacgaccctattcccgttccgggcctccgcgtcccgtgggaacgggacggacggtctgtaatttatttagtttagttacgtttactaattaactaccgaacctaagtgtaaccgtacggtttcgggttggttaccgggacggggaccgggtaccgtacggtaccgtcgggtaacccgttcgacgggttaccgaacccggacccggttaacggcccgttacccgggtccccccgttacggtcccgttacccgttcccgttacccggtttcccccgtccccttacccgg

SEQ ID NO: 274882 - DNA, 696 bp, Homo sapiens
  misc_feature: GYAE6OF02IRVHV.27.23.C01.1.454.CMB.1.raw
  modified_base (231)..(231): a, c, t, g, unknown or other
  misc_feature (231)..(231): n is a, c, g, or t
  modified_base (459)..(459): a, c, t, g, unknown or other
  misc_feature (459)..(459): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgcttataactttatcttgttggtaccgacacggaccccaggcactcgtaccccaactcatttctttatgtatgtcagtaactccggccccgtagggtttctgtactcgtcctttctagtcggccttacctaagttccgtcgtaccctacgaccggtcccctcccgtacgaccctacgtcccgtcccgggcctcccgacgtccgtaggacggacggnggaccttaggtaactttagtttattggttaagtttcctaattaactaaccgtaaacccgtagtacgtaaccgttacggtttgggtcggttccgggacggggtaacggtaccggaggttaccgtaccggtcccgttaccgtaggtaccgaccgaccccggtaagggtccctcccggaccccccgttcggtaccctaccgttcccgtttacccggtttcccccctacccgttaccccgg

SEQ ID NO: 274883 - DNA, 672 bp, Homo sapiens
  misc_feature: GYAE6OF02IJAFJ.27.23.C01.1.454.CMB.1.raw
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (638)..(638): a, c, t, g, unknown or other
  misc_feature (638)..(638): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtcctccgtggacaggtcgatccacctatctcctgcacgtggaacccngatgacgttggncttaataacttntctgttggtaccgacaggaccaggcactcgtacccaactctatttcttatgtatgtactagtaactccggccccgtagggtttctgtactcgtcttactagtcgacctactaacgtctacgtacccgtaacgccggtccctcccgtacgaccctacgtccgtacccgggtcctacgccgacgtacgggacggacgtacggtctaggtactttaattagttagttacgttataacttaacgtaacctaacgacgttacgaacgtacggtttacggggtcgttaccgggacggtaacggggaaccgtacggtcctacgggttacctacccgttaacgggcctaacggcccgaacggtcctcccggtcccccgttggtacccnccggtttccgtcccgttaccccggtccttacccg

SEQ ID NO: 274884 - DNA, 743 bp, Homo sapiens
  misc_feature: GYAE6OF02F2OM7.27.23.C01.1.454.CMB.1.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactcggaacccgcgatgacgttggtncttaataactttntctgttggtaccgacacggaccaggcactcgtaccccaaactctattctttatgtatgtactagtaacgtccggccccgtaggggtttctaggtactcgtcttctagtcggtctaccaagtcctcgaccctacgaccggtccctcccgtcgaccctacgtccgtcccgggtcctaccgacgtccgtaggaacgggacgtacgggtctacggttaattttaacgtttaatttggtttaacgttacgtaacttacgtaacctaaaccgtaggttacgtaaccgttaccggtttgggggttacggttaccggggtaccggggtaacggggtacccgtacgggtaccgtaccggttaccccggttaccgttacggttaccgaaccggtaaccccggtaacgggtccccgttacccggtacccccggttaccgggttaccctacccggtttcccggttaccccggtttaccccccgtacccccttaccccgg

SEQ ID NO: 274885 - DNA, 659 bp, Homo sapiens
  misc_feature: GYAE6OF02JD8F3.27.23.C01.1.454.CMB.1.raw
  modified_base (342)..(342): a, c, t, g, unknown or other
  misc_feature (342)..(342): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccccgcgatgacgttggtgcttataactttatctgttggtaccgacaggacccaggcactcgtaccccaaactcatttctttatgatgtcagtaactccggcccctaggggtttcngtatccgctttctagtcggctacctaagtcctcgccttacgaccggtcctccctcgacccatccgtcccgggtcttccgacgtcccgtaggacggacgaggtctagtatttattattcgttagtttcataactaacaactaggtacactaccgttgggttcgttcgggacgggtacgggtaccgaggtaccgtcgtaccggttcgttaacgggtccgaaccggtaccccgaagggtaccccgttcccggtacccccccgttcgggttacccctacctttcccggttacccggtttccccccggttaccccttccccg

SEQ ID NO: 274886 - DNA, 675 bp, Homo sapiens
  misc_feature: GYAE6OF02FRL9J.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtgtcttataactttatctgttcggtaccgacgaggaccaggcacgtcgtacccaactcattctttatgatgtacagtaactccggccccgtaggggtttctgactcgtcttactagtcggtctaccgaagtctcgtacctacgaccggtcctacccgtcgacctacgttccgtcccgggcctccgacgccgttacggacggacgacggtctagtaatttacgttattagttaacgttctaatactaacgaaccgtagttacgacgttacgttggggtcgttcggggacgggtaacggggacctacgggtaccgttacggacccgttacgtacgggtaccgtaacggacccggaacgggtcccgtacccgggtccccccgttacggtaccccgtacgtttcccgtcccggtttcccccgaccccgtttaccccg

SEQ ID NO: 274887 - DNA, 729 bp, Homo sapiens
  misc_feature: GYAE6OF02JW2WJ.27.23.C01.1.454.CMB.1.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacctatcctcctgcacgtcggaacccgcgatcgacgttggngcttataactttntcttggttaggtaccagtacggacccaggcacgtcgtaccccaaatctatttcgttatcgntcgtacagttaacnccgggtaccccgtaggggtttcngtactcggtcttactagtcggcctacagtcctcgtactaccgaccggtcctcctacgactactccgtccgggtcctaccacggtccctagggaccggtacgggacgttccgtaagtaacgttttacttaacgtttcggtaactttccgtaaatttaccgtaaacctaaaccgtaggttaccggaacttttaaccgggttaggggtttcggttcccggggaacgggggtaccggtaaccggtaacgggtcggttaaccgggtaccccggtttacggacggttacccggaaccggtaaccccggtacggtcccgtacccggtccccggtacggtcctaccgttacccgtcccgttccccggtacccctccgg

SEQ ID NO: 274888 - DNA, 612 bp, Homo sapiens
  misc_feature: GYAE6OF02H4D2G.27.23.C01.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (325)..(325): a, c, t, g, unknown or other
  misc_feature (325)..(325): n is a, c, g, or t
  modified_base (361)..(361): a, c, t, g, unknown or other
  misc_feature (361)..(361): n is a, c, g, or t
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (437)..(437): a, c, t, g, unknown or other
  misc_feature (437)..(437): n is a, c, g, or t
  modified_base (605)..(605): a, c, t, g, unknown or other
  misc_feature (605)..(605): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacaggtcctgggcccagtctgccctgactcagcctgccctccgtgtctgggtctccgtggacngtcgatcaccatcctctgcacgtcggacccgngatgacgttggtcgtctttataacttttattcttggttacggtaccgacgacggacccgaggctactccgtacccaactctatttctttatntagtgtctacgtaactccggaccccgttgggtttcngtacgtcgtacttctagtcgtctacagtcncgtcctacgaccgtcctccncgacctcgtcgtccgctccgacgccnggacgcgtagcgtatactttagttattattagtactataactaaccaacgtatagtaccgtagtttcgggttgggtcgacggggcgtacgcgtacgtcgaccggtcgtacggtcgaccgaccgtacggccgtccgaccccgttggcctaccgttcctcgttacccccnctacccg

SEQ ID NO: 274889 - DNA, 874 bp, Homo sapiens
  misc_feature: GYAE6OF02I0P4R.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttatactttatctgttggtaccgacacggacccaggccactcgtaccccaaactctactttctttatgtatgtcagtaacgtccggtcccccgtaaggggttttcctaggtacgttccggtcctttactacgttcggtacctaccgtaaacggttccttacggtaccccttaaccgtaacccgggtccccttaccccgttacggaacccctaacgttccccggttccccggggtaccttcccccgaacggtccccgttaagggaccggggtaaccgggtaacgggtaccgttacggttaaacttttaacgtttaacgttttacggtttaacggtttaccttaaatttaaccgttaaacccgtaaacccgtaagggttacgtaaacccgttacgggttttcgggggtttacgggtttcccgggggtaaccgggggtaaccggggtaacccggtaacggggtacccgttaccggggttaaccccggtttcccggttaacgggttacccgtaaccgggtacccccgtaaacggggtcccgttaccccgggttacccccccggttacgggttaccccgtacccggtttccccggtttccccgggttttacccccccggcccccgtttaccccgg

SEQ ID NO: 274890 - DNA, 749 bp, Homo sapiens
  misc_feature: GYAE6OF02F1Q9P.27.23.C01.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (346)..(346): a, c, t, g, unknown or other
  misc_feature (346)..(346): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacngtcgatcaccatcctcctgctacgtcggaaccccngatgtacggttggtcgtctttaattaactttatcgttggttacggtaaccgacgaacgggaccccaggcctacgttccgtacccccaaacttcgtacttttaccttttagngtacttcgtacgtaacgtaaccgtcccgggtacccccgtaggggttttctggtacttccggttactttcgtacgtcggtacctaccgtaacgttccgtcgtaccctaccggtacccggtccctacctccgtaacctacgttcccgtcccgggctaccgaccgtccgtaggacgggtacggtacggtcgtagttaatttagttagttacgttagttactatacctaactaccgtagtacgtacgttacggttcgggttacggttcgggacggtaacgggtaccggacggtacgtaccgtaccgttaccgtacggtaccgaccggacccgtaacggtcccgtacccggtaccccgttaccggtacctacccgttccggttaccccggttccccgtcccgtacccg

SEQ ID NO: 274891 - DNA, 745 bp, Homo sapiens
  misc_feature: GYAE6OF02HDMZQ.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgngatgacgttggtgtacttataactttatcttgttcggtaccgacacggacccaggcactcgtaccccaaactctatttctttatgtatgtcagtaacgtccggccccgtaggggtttctgacttcgtcttctagtcggcctaccgtaagttcctcgtaccctaccgaccggtcccttcccgtacgtaccctacttcccgtcccgggtacctacccgacgtcccgtaggaacgggacggacggtctaggttaactttagtttacgtttaggttaactttcgtaaattaaccgttaaaccgtaacccgtaaggttaccgaaccggttacgggttttcggggttcgggtttaccggggaccggggtaacgggacccggtagggtacccgttacggtaccccggttccggtaacggtccgaacccggtacccggtaacgggtacccgtccccggtccccgttaccgggttaccctaccggtttccccgttccgttcccccggtaccccttccccgg

SEQ ID NO: 274892 - DNA, 664 bp, Homo sapiens
  misc_feature: GYAE6OF02F1EHT.27.23.C01.1.454.CMB.1.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggtcgatcaccatcctcctgcactggaaccccngatgacgttggtncttataactttntctgttggtaccgacacggacccaggcactcgtaccccaactctatttcttatgtatgtcagtacgtccggccccgtaggggtttctgtactcggtcttctagtcggtctaccgtaagtctcgacctacgacggtccctcccgtacgacctactccgtccgggtcctccgacgtcccgtaggacggtacggacggtcttacgtaatttacgttattggttaacgttcttaataacctaacgaacctaggtacgtacgtacggtttcgggttacggttacgggacgggtacgggacctaggtccgtacggtacccgttacgtagggtaccgcggtacccgaacggtccgtacccgttccccgtccggtacctccgttaccgtcccgttacccctaccccgttacccg

SEQ ID NO: 274893 - DNA, 739 bp, Homo sapiens
  misc_feature: GYAE6OF02FEKJK.27.23.C01.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (730)..(730): a, c, t, g, unknown or other
  misc_feature (730)..(730): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatcctcctgcactcggaacccngatgtacgttggtntacttataacttntctgttcggtaccgacgtacggaccctaggcctacgtccgtaccccctaaacttctattttacctttatagtacttacgtacgtaacggttaaccgttcccggggtaccccccgttagggggttttactacggtaacgttccggttacttaccgtacgtccggtaccttaccgtaacgttcccgtacgtacccgtaaccggtacccggtccccttacccggtacgtaacccctacgttcccgtcccgggtacctacccgtacgccgttagggaaccgggacgtaggtaccgttagttacttaacgttagtttaggttacttactaattaacgtaacctaaccgtagtacgtacgtggtttcgggtcggtacgggacgggtacgggactacggtctaccgtaccgtacgtacggccgtacggaccgaccggtccgtcccgtcccgacgtctaccgttccgtacccggtcccnccgtacccg

SEQ ID NO: 274894 - DNA, 784 bp, Homo sapiens
  misc_feature: GYAE6OF02HM700.27.23.C01.1.454.CMB.1.raw
  modified_base (236)..(236): a, c, t, g, unknown or other
  misc_feature (236)..(236): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccaggtctcgccctgactcagcctgcctccgtgtcgtgggtctccgtggacagtcgatcaccatctcctgcacgtcggaacccncgatcgacggttgtgctttaataactttatcttggttcggtaccgacgacggaccccaggtaccaccgttaccgtaaccccctaaaacttcctaattttcctttaagtagtacttcgtactaacgtaacgtccccgggtaccccggttaggggtttctgtacttccgtacttcgtagtcggtctacgtaacggttctacgaccctacgtaccggtccccttcccgtacgaccttacgtacccgtcccgggacctaccgacggtcctagggacggacggaggtactagttagtttaatttagttacggttacgtttacaacttaactaaccgtaacgtacgttcgtaacgttacgggttaggggttaccgggttcggggaacgggtacggggtaacccgagggttccgttacgggacccggtttacggtaacggttaccggtaacccggaacccggtaacggttccccgttaccccggtaccccccggttccggttaccgttaccccgtttaccggtcccctttaccccccgtaaccccgtttccccgg

SEQ ID NO: 274895 - DNA, 744 bp, Homo sapiens
  misc_feature: GYAE6OF02ISCN7.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatccaccatctcctgcacgtcggaacccgcgatcgtacggttggtgtactttaattaacttttatcttggttaggtaccgacgacggacccaggccacgttccgtacccctaaactctaacttttcctttaatcgtattcgtacgtaacgttaaccgttccccgggtaccccccgttaggggttttctacgtacgttaccggtcctttacgtagtccggtccctaaccgtaacgttccgtcgtaccctaaaccgccggtccctcccgtacgtaccctacgtcccgtacccgggccttaccgcgtccgttacggaacggacggtcggtacttagtagtttacttagtttacggttaacttactaacttactaacgtacgagttacgacgttcggttggggttacgtacgggtacgggacggtaccggtaggtccgtacgtacccggttcggtaacggtaccgccggtacccgaacgtcccggtaccccgtccccggttacgtccctaccgttcccggttccggttcccccacccttcccgg

SEQ ID NO: 274896 - DNA, 891 bp, Homo sapiens
  misc_feature: GYAE6OF02HAE3K.27.23.C01.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatcctcctgcactggaacccgngatgacgttggtntcttataacttttntctgttggtaccgacgacggacccaggccacctcgtaccccaaacttcgactttctttagtgatcgtacagttaacgtccgggtccccgtaggggtttcctagtacgttccgtctttaccgttacgtcggtccttacccgaaagttccgttacgaccccttaaccgtccgggtccccttaccccgtcgaaccctacgttcccgtcccgggtacctcccgtacggtacccgttacgggaacgggtaaccggtacgggtaccgtttacggtaaacgtttttaagtttaacgttttgggttaaacggttttaccgtaaacgtttaaccgttaaacccgtaaacccgttaacgggttacggttaaaccgttaacgggtttttacgggggttaccgggtttaccgggggaaccgggggttaaccgggggtaaacccggttaccgggggtccggttaacccggggttaacccgggtttacccgttacgggggttaacccgtaaaccgggtacccccgggttaaaccggggtccccgttaccccggggttacccccccggtttacccgggttaccccgttaaccccgtttccccgggtttacccggttttaccccccccgtaaccccgtttacccccgg

SEQ ID NO: 274897 - DNA, 864 bp, Homo sapiens
  misc_feature: GYAE6OF02FTVO0.27.23.C01.1.454.CMB.1.raw
  modified_base (277)..(277): a, c, t, g, unknown or other
  misc_feature (277)..(277): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcgagggcacgtacgggtccgtcgggcctagtctcgccctgtacctcgacgtcctcgtcccgttccggtcgttcggttcgggtccttccgtaggactacggtcgactccaacctacttcctccgtcgaccacgtaccgggaacccgngtatcggtacggttggtgttacttaactttaactttatcgttggttaccgggtaccgacgaccggaaccgacggcctacgttccgtaacccctaacttcttaacgttttacttagtagtacgttcgtaacgtaacgtaccggtccccgggtaccccgggttagggttttccaggtacgtccggttcttacgtacgtcggtcctacgtaacgttcctcgtaccctacgtacccggtccctccgtacgaccttacgtcccgggtccggtccctccgtaccgtcccgtagggaccgggtacggtacggtaccttaaggttacttttaactttagtttacggttacttacttaagttaacctaaacctaaacggtacgttaccgttaacgttacggggttttcggggtaccgggttaccggggacgggggtaccggtaccggtacggttccggtacccggttacccgttcgggtacggtacccggaccggtaacccggaacgggtcccgttacccccggttcccggttacgggttaaccccttacccgggtttccccgtttaccccggttccccccggtacccttacccgg

SEQ ID NO: 274898 - DNA, 787 bp, Homo sapiens
  misc_feature: GYAE6OF02HJJOH.27.23.C01.1.454.CMB.1.raw
  modified_base (407)..(407): a, c, t, g, unknown or other
  misc_feature (407)..(407): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcacgcctgcctccgtgtctgggtctccgtggacagtcgatccaccatcctcctgcacgttcggaacccgcgatgacgttggtgtcttaattaactttatcgttgttcggtaaccgacgacggacccaggccacgtacgtaccccaaactctaactttacctttaagtgtacgttacgtacgtaggttaaccgttcccgggaccccgttaggggtttctagtacttcgtcttacgtacgnggtcctaccgtaacgtcctcgacccttaccgccgtccctacctcgaccctacgtccgtaccggtcctccgacgtccgtacggaacgggacccggtaaggtcttaagttacgtttaactttaacggtttacggttacgtttaaccgtaagtttaacctaaaaccgttaaacccgtaaggttacggaacccgtttacgggtttacgggggttgggtttacccgggacggggtaacgggtaacccgtacgggtcctttaccgggacccgttacgggttaaccgttccgaacccgggtaacccgtaaccgggtccgttccccggacccccggtttgaaccccttaaccgtttccggtttccccgttaccctcccccttaaccgg

SEQ ID NO: 274899 - DNA, 699 bp, Homo sapiens
  misc_feature: GYAE6OF02JX9TN.27.23.C01.1.454.CMB.1.raw
  modified_base (181)..(181): a, c, t, g, unknown or other
  misc_feature (181)..(181): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (319)..(319): a, c, t, g, unknown or other
  misc_feature (319)..(319): n is a, c, g, or t
  modified_base (490)..(490): a, c, t, g, unknown or other
  misc_feature (490)..(490): n is a, c, g, or t
tcagagcgtcgtctcacgaccggtgctcgatttagtacacgtgattagggattggggggggtcgtcaggaggcagcgctctcgggacgtctccaccatggcctgggctctgctattcctcaccctcctcactcaggcacagggtcctgggcccagtctgccctgactcagcctgcctccgngtctgggtctcctggacagtcgatcaccatctcctgcactcggaaacccgcgatgacgttggngcttaataaccttttntctgttcggtaccgtacacggtacccaggccactcgtaccccaaactctaacttcttangtatgtcagtaactccggtcccccgtaggggtttcctggactcgtcgttcttagtggtcctaccaaggttcctcgtcccttaacgaccggtccctccccgttagaccctacgtccgttcccgggccttacccgacgccgttacgagggaccggacggtcgtagtaactttnttaagtttcggttaagtttcaattaactaaccgtaaccgtagtcgtaccgtaacggttcgggttacgggttcggaccgggtaacgggtacgtaacggcctacggtaaccccgtcggttggtaaccgccggtaacccgaacggtccgtacccggtcccccgttaacggtcccgtaccgttacctacccggtttcccccaacccgttcccg

SEQ ID NO: 274900 - DNA, 718 bp, Homo sapiens
  misc_feature: GYAE6OF02HLIVA.27.23.C01.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtgtcgtgggtctctggacngtcgatcacntctcctgcacgtcggaaccccgngactggacggttggntacttataacttttntcgttgttggtaccgacgacggaccaggcactcgtacccctaaactcgtactttcttatgtagtcgtactaggtaaccgtccggtacccccggtgggtttcgtgtacgtccgtcttcttagtcggtacctaccgacgtcgtcgtaccgtccgaccgtcccgtcctacgacccgtacgttccgtcccggtctccgacgtcgtacggagtacgagtctagtatttagttagttggttattacgaacttaacgtaacctaaccgtagttaccgaacgttacgggtttcgggtcggttacggggaccggggttacggaccgtagggtaccgtaccggttacccggtcggtaacggtaccggtaacccggtaaccggtaaccggttcccgtacccggtcccccggtttacggtacccgttaacccgttccgtttacccccgtaccccggtcccctttaccgg

SEQ ID NO: 274901 - DNA, 827 bp, Homo sapiens
  misc_feature: GYAE6OF02H3XJ5.27.23.C01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtcctcctggacagttcgatcaccatcctcctgcacgtcggaaccccgngaatcggacgttggtcgtactttattaacttttatcttggttcggtaccgacacggtacccaaggctactcgtaccccaaattcaatttctttatcgagtcgtcaacgttaactccgggccccgtaggggtttctagtacgtccgtacttcttagtcggtcctccgtaagtcgtcgtacccgtacgaacccggtcctacccgtacgtacctaccgtcgtcccggacctttaccgacggtcccgtacgggacgggtaacgtacggtacgttacggttaacttttagtttacgtttaaggttacgtttaccgtaaattaaccgttaaccgtaaacccgtaggttaaccgtaaccgttaaccggtttgggggtttaccggtttaccggggaaccggggaaccgggtacccggtaacgggaccgtttaccgggtacccggttacccgttaacggggttacccgaaccggggtaacccccggaacgggttacccccggttacccccgggttaccccccggtttcccgggttaacccgtaccccgggtttacccccgtttacccgggtttaccccccctaacccccgtttacccccgg

SEQ ID NO: 274902 - DNA, 744 bp, Homo sapiens
  misc_feature: GYAE6OF02FT803.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccngatggacgttggtgcttataactttatctgttggtaccgacaggacccaggcactcgtaccccaaactcattctttatgattgtctagtaacgtccggtcccccgtagggtttctgacgtcgtcttctatggctccaagttctgcctacacggtccctccctgaacctactccgtcccgggtcctcccgtagcccttagggaacggtacggacgggcttaggtaatttacgtttaagttacgtttaagttaccgtaatttaaaccgtaaccgtaacccgtaaggttaccgaaaccttacgggttttacgggggttcggtttaccgggggaccgggggtaacgggtaacccggagggtacccgttaccgggtaaccccggtttacccgtaggggtacccgttaacgggaacccccgtaaccggggtacccttccccgggtaccccccgtttcggggtacccttaacccgtttacccggttacccggtttcccccccgtaccccgtttaaccccgg

SEQ ID NO: 274903 - DNA, 723 bp, Homo sapiens
  misc_feature: GYAE6OF02IW458.27.23.C01.1.454.CMB.1.raw
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggngcttaataactttatcttgttcggtaccgactacggacccctaggcactcgtacccccaaactcctatttctttatgtatgtactagtaacgtccgggcccccgtaaggggtttcctggtactcgtccttctatcggtctaccgtaagtcctacgcctaccgaccggtaccctcccgtacgacccacgttccggtccgggcctcccgacggtcctcgggagggaccggagggtctagtaactttacgttagtttacggttacgtttacgtacgttaacgtaaccgtaaaccgtaaggttacggtaaccgttaccggtttcgggggttacggttccggggtacggggtacggggtaaccgtacgggtacgtaccggtacccgtaccgttacgggtcccgaccggtacccgtaaacgggtccgtacccggtcccccgttcggtacctaccgttaccgtcccggttccccggtccccttacccg

SEQ ID NO: 274904 - DNA, 774 bp, Homo sapiens
  misc_feature: GYAE6OF02JROSQ.27.23.C01.1.454.CMB.1.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (396)..(396): a, c, t, g, unknown or other
  misc_feature (396)..(396): n is a, c, g, or t
tcagagcgtcgtctcacgaccggtgctcgatttagtacacgtgattagggagttggggggggtcgtcgaggaggcgagcgctctcgggacgtctccaccatggcctgggctctgctattcctcaccctcctcactcagggcacagggtcctgggcccagtctgccctgactcagcctgcctccgtgtcctggggtctccgtggaccnggtccgatccaccatcctccgtgaccncctcgggaaccccgcgatcggacgtttggngtactttaataaccttttgtcgttagttcggtaccgtacgacggaccacggctactccgtaccccaaatctattacttatgtatcgtcaacgtaacgccggtacccgtagggtttcctaggtctcgtacttntacgtcgtcctacgtaagtctcgtacctaaccgcggtcccttccgtacgtacctaccgtccgtcccggcctacccggtacgtcccggtaggtaacggggacccggtaacggtcgttacggttaacctttaagtttacgtttacggtttaacgtttacctaactttaaccgaacgtaaaccgaaggtttaccgacgttaccgggttaggggtttaccggtttaaccggggccggggttaaccgggtacgtacgggtaccgttaccggtacccggttaccgttaacggtccgaaccggtacccggtaacggggcccttaccccgggcccgttacccggtcgttaccgttccgtttaccccggttcccctccccgtacccg

SEQ ID NO: 274905 - DNA, 681 bp, Homo sapiens
  misc_feature: GYAE6OF02JIF8U.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatcgacgttggtgcttaataactttatctgttcggtaccgacaggacccaggcactcgtaccccaaactctactttcttttactgtatgtctaagttaacgtccgggtcccccgtaggggttttctggtaactccggtctttactagtcggtacctcctaacgtctccgtcctaccgaccggtcccttcccgtacgaccctacgttccgtccgggtcctccacgccgtaggacgggacgacggtctagtacttattagttgttacgttactaactagttaaccaaccgtagtacgtacgtaacggtttcggggtgttaccggggacgggtacgggaccgagggtctaccggtacccgtcgttacggtccgtacgacccggtaaggcccgttccggtcccccgtacggtccttacccgtccgttccggtttaccccgcccgtttacccg

SEQ ID NO: 274906 - DNA, 827 bp, Homo sapiens
  misc_feature: GYAE6OF02FF0TX.27.23.C01.1.454.CMB.1.raw
  modified_base (240)..(240): a, c, t, g, unknown or other
  misc_feature (240)..(240): n is a, c, g, or t
  modified_base (546)..(546): a, c, t, g, unknown or other
  misc_feature (546)..(546): n is a, c, g, or t
tcagagcgtcgtctcacgaccggtgctcgatttagtacacgtgattagggattggggggggtctcaggaggcagcgctctcgggacgtctccaccatggcctgggctctgctatcctcaccctcctcactcagggcacgagggtcctgggcccagtctgccctgactcacgcctgcctcgtgtctgggtctccgtggacagtcgatccacctatcctcctcgaccacgtcggaaccccgngtatggtacgtttggtctactttattaacctttagtccgttggttaaccggaccgaaccgacggacccctaggaccctaccggttacctaaccccctaaattcttaacggttttaaccttagtacgtacgttacgtaacgtaacggttaaccggtccccgggttacccggttaggggttttcacgtaccgttccgttacgttacgtacggtccgtacctacgtaacgttccgtaccgacccttaccgtcccgtccctaccgtaccgtaccgtcgtcccggtaccggacctaccggacggtacccgnggggaaaccggtacggtagtacggtttactttaactagtttacgttacggttaactaaccgtaactttaaaccgaacccttaggacgttacggttaaccgggttgggttacgggtaaccgggtaggggaaccgggttaaccgaccttacgggtccgtaccggttacccggtacgacccggtaccgtaaacccgggccggtaaccctccccggtacccgtacccccgggttacgtacccttaccccggttcctttaacccccggtaccctaccggttaaccg

SEQ ID NO: 274907 - DNA, 527 bp, Homo sapiens
  misc_feature: GYAE6OF02GF066.27.23.C01.1.454.CMB.1.raw
  modified_base (233)..(233): a, c, t, g, unknown or other
  misc_feature (233)..(233): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
  modified_base (510)..(510): a, c, t, g, unknown or other
  misc_feature (510)..(510): n is a, c, g, or t
tcagagcgtcgtctcacgaccggtgctcgatttagtacacgtgattagggattgggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaaccccgngatgacgttggtgcttataacttttatcttgttggtaccgacaggacccaggcactgtcccccaaactcattctttatgatgtcagtaatcggcccctaggggtttctgatcgcttctatcggctaccagttctacgcctactaccggccttccctgaccatccgtccggctcacgcctgacggacgagctgattatattgttagtcatanacaacngtnactgttggtntcggcgaggcaggcngaccgtcaggcacgccaggctcgccctcgtcnctctcgtcccacctccg

SEQ ID NO: 274908 - DNA, 690 bp, Homo sapiens
  misc_feature: GYAE6OF02HTMLB.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctcgccctgactcagcctgcctccgtgtctggtctcctggacagtcgactcaccatctcctgcactcggaccncgatgacgttggntcttataactttatcgttgttcggtaccgacacggacccnggcactcgtaccccaaacttctatttcttaagtgattcgtctaagtaacgtccccggtaccccgttaggggtttccnggtacttccgtacttctacgtcggtcctacgtaacgtctaccgtacctacgcccggtcctcccgtacgacctacgtcccggtaccgcctcgacgccgtaggaacggcgtagtctattagtttatttaagttgttaacgttactaactaacgtaaccaacgtacgttacgtacgttacgggtttgggtacggttaccggggcggtacggaacgtcggacgttccggaccgttacgtacggttacccgaaccgtacccggtagtccccgtcccggtacccggttcgggtaccttacccgttcccgtttccccgttccccgtacccgttacccg

SEQ ID NO: 274909 - DNA, 769 bp, Homo sapiens
  misc_feature: GYAE6OF02JXP52.27.23.C01.1.454.CMB.1.raw
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (759)..(759): a, c, t, g, unknown or other
  misc_feature (759)..(759): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctcgccctgactcagcctgcctcgtgtctgggtctcctggacagtcgatccaccattcctcctgcctacgtcgggaacccgcgattcggacgtttggngtacctttattaacttttntcgttgttacggtaccgacgacggacccacggacaccgtcgtaccccctaaactactacctttagttttaacttgtattacgtcgtaacgttaacgttcccgggtaccccccggttaaggggttttcctcggttaacgttcccgttcgttttaccgttaacgttcggtaccgttacccgtaacgttccgttacggtcccgtacccgtaaccggtccccgttaccccgttaccgaccctaaccgttcccggtcccggtaccgtccgtaccgtccgtcggtacggacggacgtacgtgttactttagttacgttagttacgtttactattactaacgtaactagtacgtacgtacgttgggttacggtcggtacgggaccgggtaccgtacggtcgtaaccgtccgggtacgttacggtcgaccgtaccgaaccggtctcccgtaccccgttcggtccgtaccgttcccgtttaccggttaccccncccgtacccg

SEQ ID NO: 274910 - DNA, 807 bp, Homo sapiens
  misc_feature: GYAE6OF02HHE8S.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctctcactcaggcacaggtcctgggcccagtctgccctgactcagcctgcctcgtgtctgggtctcctggacagtcgatcaccatctcctgcactggaacccgcgaatgaacgttggtgcttaataactttatcgttgttcggtaccgtacacggtacccaggcactcgtaccccaaactcgtaatttctttactcgtacttcgtactagttaacgttccgggcccccgtaggggtttcctacgtaacgttccgtactttctaagtcggtacctaccgtaacgttccgtacgacccgttaaccgaccggtcccttaccccgttacgaacccgtacgttcccgttcccggggccttacccgacgggtccctagggaaccgggtaccggtaacgggtacgttaggtaacttttaacgttacgtttacgggttaacggtttaccctaagttaaccttaaaccgtaacccgtaaggttaccgtaaaccgtttaccggtttacggggtttacgttacccggggtaacggggtaaccgggtaacccggtacggggtaccttaccgggtaacccggttaccggttaacgggttacccgaaccggtaccccgtaaacgggtcccgtacccggtaccccgttacgggtaccctaccgttccggttaccccgtttaccccgaccccgtttacccg

SEQ ID NO: 274911 - DNA, 635 bp, Homo sapiens
  misc_feature: GYAE6OF02GN9EH.27.23.C01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccgngatgacgttggtncttataactttntctgttggtaccgactacggacccaggcactcgtaccccaaactctattctttatgtatgtacagtaacgtccggccccgtagggtttctgattcgcttactagtcgtctccaagtctcgtacctacgaccggtccctccctacgacctacgtccgtccggctccgacgtccgtacggacgggacgacggcgttagtactttattagttaggttacgttactattaactaaccaaaccgtagtacgactacggttcggggttcggttcgggacgggtaacgggaccgacggtccgtcggtacccgtacgtacggtaccggcgacccgtaaggccgtcccgccccgtcggtccacttccgtccgttaccccacctcccg

SEQ ID NO: 274912 - DNA, 774 bp, Homo sapiens
  misc_feature: GYAE6OF02ILZF8.27.23.C01.1.454.CMB.1.raw
tcagagcgtcgtctcacgaccggtgctcgatttagtacacgtgattagggagttggggggggtctcaggaggcagcgctctcgggagtctccaccatggcctgggctctgctattccctcaccctcctcactcagggcacgagggtcctgggcccagtctgccctgactcagcctgcctccgtgtctgggtctccgtggacagtcgatccaccatctcctgcaccgtcggaaaccccgcgtaatcggtacggtttggtgtactttaattaacttttagtcttggttacggtaccgacgaccggacccacggaccactcgtaaccccaatcctatttctttatgtatacgtctaagtaacgtcccggacccgttaggggtttctagtacttccgtactttactagtccgtacttaccgtaaggtcctcgtacccgtacgtacccggtccctaccgtactaaccgtaccgttccggtacccgggtccttcccgaacggtacccgtacgggaacgggaaccggtacggtcctaacggtttaagtttaaccgtttttaagtcggttttaaacgttactaaccttaaacgtaacccgaaacgttgtaactaaccgtttacggttgggtttaccgtcgggacggtacgggtaccgcggtaccgtaccggtacccgtcggtaacggtaccggaccgtaacccggacggttcccgtcccgttaccccggtccggttacctacccgtttacccgtcccgtttaccccccgtaccccgtaccgg

SEQ ID NO: 274913 - DNA, 703 bp, Homo sapiens
  misc_feature: GYAE6OF02F2HHO.27.23.C01.1.454.CMB.1.raw
  modified_base (231)..(231): a, c, t, g, unknown or other
  misc_feature (231)..(231): n is a, c, g, or t
  modified_base (348)..(348): a, c, t, g, unknown or other
  misc_feature (348)..(348): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaacccgngatgacgttggtgcttatactttatcttgttggtaccacgacggacccaggcactcgtaccccaactcatttctttatagagtgtactaaggtaactccggccccgtaggggtttcngtactcgtcttactagtcggctccgtaagtcctcgtaccctacgacgtaccctcctagaccctacgtaccgtcccgggctacccgtacgccttaggaacggtacggacggtctacggttaacttacgtttacgtttaggttacgttacttaacgttaactaacgtaacccgtaagttcgtaaccgtacggtttcggggtacggtttcggggcgggtaacggggtaccgtacgggtaccgtacggttaaccggtccgttaacggtaccgaaccggtaccggaacggtcccgttacccgtcccccggttacggtacccgttaccgttccgtcccgtttaccccgtacccttacccgg

SEQ ID NO: 274914 - DNA, 705 bp, Homo sapiens
  misc_feature: GYAE6OF02JLBSO.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggagttggggggggtcgtcgaggaggcagcgctctcgggacgtctccaccatggcctgggctctgctattcctcaccctcctcactcagggcacagggtcctggcccagtctgccctgactcagcctgcctccgtgtctgggtctcctggaccagtcgatcaccatctctgctactcggaacccncgatcgtacgttggtgctttaattaacttttatcttgttaggtaccgtaacgacggtaccacggcacgtcgtaccccaaacctcctactttactttacgtgtatcgtacaagttaacgtccggtccccgtagggttctagtctcgtcttcttatcgtctactaacgtctctacctacgtaccgtaccctccctcgaacctacctcgtcccggtctccgcgcctggacggacgtacgtcgtagtatttacgttattcggttattactaacttaacgtaacctaaccgtagttacgaccgttacggtttagggtcggtttaccgggacgggtacgggtaacccgaggtccgttaccggtacccggttccgtaacggtcccggaacggtacccgacgggtcccgttacccggtacccccggttacccgttaccgttaccgttacccggttccccccgtcccgttcccgtaacccg

SEQ ID NO: 274915 - DNA, 732 bp, Homo sapiens
  misc_feature: GYAE6OF02HM3IO.27.23.C01.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (372)..(372): a, c, t, g, unknown or other
  misc_feature (372)..(372): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctcgccctgacctcagcctgcctccgtgtcgtgggtcctcnggacagtcgatccaccatctcctgcacgtcggaacccgngatggacgttggngtactttattaaccttttatcttggttacggtaccgacgacggacccaggcacgtcgacccccaaacgtctatttcttactgtactgtcgtaagtacgtcccggaccccgttagggttttcncgtacgtcgtcttcgtagtccggacctaccgtaagttcctcggtacccctaccgtacccggtccccttcccgtacgaaccctacgtcccggtacccgggtcctacccgacggtcccgtagggaaccgggacggtggtacctagttagttttaactttagttaagttaacttcaacgtttaacaacctaacgtacgtcgtaaccgtacggtttggggtcgttccgggacgggtaacgggccgtaaggtccgttacggtccggtacccgttagggtacccgaaccggtacccaacgggttccctccccggtcccgttccgttaccgtacccttccggttccccgttccccgtccccttacgg

SEQ ID NO: 274916 - DNA, 604 bp, Homo sapiens
  misc_feature: GYAE6OF02J2P1P.27.23.C01.1.454.CMB.1.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (300)..(300): a, c, t, g, unknown or other
  misc_feature (300)..(300): n is a, c, g, or t
  modified_base (566)..(566): a, c, t, g, unknown or other
  misc_feature (566)..(566): n is a, c, g, or t
  modified_base (580)..(580): a, c, t, g, unknown or other
  misc_feature (580)..(580): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatcctcctgcactcggaacccgngatgacgttgngtcttatacttnctgtcgacgacacggaccagcactcgaccccaatctattcttangatcgactagtacgtccggacccgttagggttcagtcttccgtcttctacgcggtcctaccgtaagtccgtcgacccgtaacgccggtccctccgtacgaacctcgttccgtccgggtcctccgacggcctacgggacggacgtcggtctagttactttagttagtcgttacgtacattactaacacgtgtgacgtagttcgggtacgtcgggacgggacgtacgcggtctaccggtacgtcgtacggtcgaaccgtccaggtccnccgtccgtcgtacnccgttccgtcccgtcccgctaccg

SEQ ID NO: 274917 - DNA, 784 bp, Homo sapiens
  misc_feature: GYAE6OF02G162Y.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgccctccgtgtctgggtctcctggacagtcgatcaccatctcctgcactcggaacccngaatgacgttggtgcttataactttatctgttggtaccgacaggacccaggcactcgtaccccaaactctaatttctttatcgtatgtactagtaacgtccggtacccccgtaggggttttacctgtacgttccgtccgtttactaacgttcggtaccttaccgtaaaggttcccgtacgtaaccccgttaacccgaaccgggtccccttaccccgtacggtaaccccgtacgttacccgtccccggggtaccttcccgaacggtccccgtagggtaacggaaccgggtaggtacgtacggtaacttttaagtttaacgtttaggtttaacggtttacctaaacgtttaacgtaaacccgtaaacccgttaaggtaccgtaaaccggttaaccgttttgggggttaaccggtttccggggacgggttaaccggggaacgtacggtaccgtacggtaccgtaccgttagggtaccgaacggtacccgaagggtccttacccggaccccgttcggtacccgaccttccgtaccgtttccccgacccttacccg

SEQ ID NO: 274918 - DNA, 762 bp, Homo sapiens
  misc_feature: GYAE6OF02JCROK.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatcgacgttggngcttataactttatctgttggtaccgacacggacccaggccacctcgtaccccaaactctatttactttatgtacttgtactaagttaacgtccgggcccccgtaagggggttttcctggtaacttccggtaccttttacctagttccgggtaccttaccgtaaacggttccttacggtaccccgtaaaccgtacccgggtcccctttaccccgtaaccggtacccctaagtttccccggtacccggggtacccttacccgtaacggtccccgttaacgggaacggggtaacccgggtacggttaccgtaggttaactttttaaacgtttagttttaccggttaagtttaccgtaatttaaaccgtaaactaacccgtaagttaccgaacgttacggtttggggttacggttacgggacgggacggaccgaggtcgttcgaccggttcgtacggtacgacgtacccgaggcccgttccgtaccccgtcgtacctaccgttcgtcccgttcccaccctccg

SEQ ID NO: 274919 - DNA, 586 bp, Homo sapiens
  misc_feature: GYAE6OF02F86PG.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcactgggaaccccgcgatcggacgttttgtgtcttaataacttttatctgttcggtaccgacaggaccccaggcacctcgtaccccaaactcatttcttatgatgtcagtaactccggccccgtaggggtttctgatcgtcttctatcggctcaagtctcgcctacacggtcctcctgaccatccgtccgggcctaccgacgccgtaggacggacgaggctagtacttattattgttagttcatatacaacagtgactcgttggtgttcgggcggtacgggccaggctagacccgttcgtacggtcgaacgcccgaacggccttcgcccccgttcggtcctactcctccgttaccccacccttacccg

SEQ ID NO: 274920 - DNA, 604 bp, Homo sapiens
  misc_feature: GYAE6OF02F2662.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataactttatcttgttggtaccgacaggacccaggcactcgtacccccaactcattctttatgatgtcacgtaatccggccccgtagggtttctgtactcgtcttcgtatcggctaccaagtctcgccctacgaccggtccctccctgacccatcccgtccgggctccacgtcctaggaacggacgacggtctaggtaatttattagttgttagttactattactaacaacctagtacgacctacggtttgggtcgttcgggacgggacgggaccgaggtctcggtaccgttcgacggtccaacggcccgaagccgtccgaccccgtcgtccaccgtcgtccgttcccgcctcccg

SEQ ID NO: 274921 - DNA, 802 bp, Homo sapiens
  misc_feature: GYAE6OF02JD8GG.27.23.C01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccncgatgacgttggngtcttataacttttatcttgttcggtaccgtacacggacccaggcacgtcgtcccccaaactccatttcctttatgtacttgtctaacggttaacgtcccgggtcccccgtagggggttttctggtacgttccgtacttttcgtagttcggtccttacctaaggtctacgtacccgtaacctacccgggtccccttcccgtacgaccctacgttcccgtcccggggtacctccgaccgtcccgtaggacgggaacggtacggtctagtacgtttatttacgtttagttacggtttactaacgttactaaaacccttaccgtacggttacggtaccttaaccgggttttcggggtttacgggtttacccggggtacggggtaacgggtaacccggtaggggttaaccccgttcggttaaccccggttccgttaaccgggttacccggaaccggtacccccgtaaacgggttccccgtacccgggttccccccgtttaccgggttaccccttacccggtttacccttccccgttttaccccccgaacccctttacccccgg

SEQ ID NO: 274922 - DNA, 738 bp, Homo sapiens
  misc_feature: GYAE6OF02H8HKQ.27.23.C01.1.454.CMB.1.raw
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtcctgccctgactcagcctgcctcgtgtctgggtctccgtggacagtcgatcaccntctctgcacgtcggaacccgngactgacggttggtctacttattaactttntcgttggtacgtaccgacggacgaccaggacctactaccgtaaccccaaactcctacttttactttagtacgtatacgtactacgtaaacctcccggggtaccccgttaggggtttccacggtacgtccgttacgttaacttagtcgtaccgtaccgtaacgttcctacggtaccctaaccggccgtacccgtcccgtactacccgtacgtcccgtccgggtcctccgaacgtccgaggtaacggacgagtccgtaattaacgtttactagttcggttaacttacgtaaagtaacctaacgtaactagtacgaacgttacggtagggttcggtacgggtaccgggagggttaaccacggttaccggtacgtaacccgttaccggaacggttccgaaccggtacccgaacggtcccgcccggttacccgtccgtaccggtcttaaacccggtccgttaccccctcgttaacccgg

SEQ ID NO: 274923 - DNA, 747 bp, Homo sapiens
  misc_feature: GYAE6OF02IQB40.27.23.C01.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
tcagagcgtcgtctcacgaccggtgctcgatttagtacacgtgattagggagttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacatctcctgcacgtcggaacccgcgatgacgttggtgcttataactttatcttgttcggtaccgacaggacccaggccactcgtaaccccaaactctatttctttangtatgtacaagtaacgtcccggacccgttaggggtttcngtactcgtcttcgtatcggtcctaccgtaagtcctcgtaccctaacgaccggtcccctcctacgtaaccctacgtcccggtcccggtcctaccgacgtccgtagggaacgggacgtacggtacgttagtaacttttaagtttaactttaggttaacgtttactaacgttaaactaaccgtaaaccgtacgttacggtaaccgttacggtttcggggttaccgttaccggggaccgggtaagggtaacccggacgggtccgtacgggtaacccggttaccggtaacgggttacccgaacgggtaccccgtaacgggtccccttaccccggtcccccggttacggtacccgtaccgtttcccggtacccgttttcccccgccccgttaacccg

SEQ ID NO: 274924 - DNA, 742 bp, Homo sapiens
  misc_feature: GYAE6OF02H1W2G.27.23.C01.1.454.CMB.1.raw
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgaggtcctgggcccagtctgccctgactcagcctgcctcgtgtctgggtctccgtggacagtcgatcacctatctccagctacgtacggaaccctgagtcgtacggttggtactactttaagttaactttatcgttcggttacggtaccgaacgacggtaccgagactcttaccgtaaccctaaacgtcttaattcctttaagtgtaacttagtacttacgtaacgtaccggtcccgttaggttccagtacgtcgtctacgtagtccgtactacgtacgtctcgtaccgtaaccgaccgtcctacccgtacaacctacgttccgtaccggtcctacgaccgtccggtaagaaccgggtacgtaacggtacgttagttaaccgttagttttaactcggtttaacgttaacttaactaaccgttaaaccaagtacggtacgtaaccgttcggtttacgggtacggttcggggaaccggtacggtaacgtacggtaccgtaccgaccgttaccgtacggtaccgtaacgggacccgtacggtacccgttacccgccccgttggtacccgacccttttaccggcccgttccccgtacccgtacgg

SEQ ID NO: 274925 - DNA, 615 bp, Homo sapiens
  misc_feature: GYAE6OF02FRBHG.27.23.C01.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactggaacccngatgacgttggncttataactttntctgttgtacacgagaccaggcactcgtaccccaactctattcttatgatgtacagtaactccggccccgtagggtttctgattcgcttctacgtgcctacacgtctcgaccctacgaccggcctaccctgacctactccgtaccggctccgacgccgtaggacggacgtacgcgtagtactttagttagtttcgttaagttctaatactacaaccgtgtacgtacgtacggtttgggtcgttacggggcgggtacggaccgtacggtctaggtacccgtacgtacggtcgtaccggacccgacggtccgtcccgccccgttacgtcccaccgttaccgtccgttacccccacccgttacccg

SEQ ID NO: 274926 - DNA, 831 bp, Homo sapiens
  misc_feature: GYAE6OF02JEMXO.27.23.C01.1.454.CMB.1.raw
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (345)..(345): a, c, t, g, unknown or other
  misc_feature (345)..(345): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctcgccctgactcagcctgcctccgtgtcgtgggtcctcgtggacagtcgatcaccatcctctgcacgtcggaacccgcgaatcggacggttggngtacttaagttaactttntcgttggtttacggtaccgtacgaacggacccgtaggccaacgtccgtacccccaaaatctactttctttacgngtactcgtacaaggtaaccgtcccggtccccggttaaggggttttctaggtccgttacgttccgttacgttacgtacggtccctaccgtaacgttcctccgtacctacccgtaccggtcccctcccgtaacgaccctacgtcccgtccgtaccgtcccgtacgtccggtaggaaccgggtaccggtacggtccgttaagtacgttttaacgtttagttaccgtttacggtaccttaaagttaaccgtaaccgtaaccgtagtaaccgaaccgttacggtttacgggttcgggttaccgggaccgggttacgggtaacccggtacggtacccgttacggttacccggttaccgggtaacggggtaccctaacccggggtaaccggtaccggttaccccggtacccggtttacccccggttacccggttaccccggttacccgttacccgggtttcccccgtacccccggttacccccgttaacccgg

SEQ ID NO: 274927 - DNA, 754 bp, Homo sapiens
  misc_feature: GYAE6OF02IZ0W9.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactcggaacccgngatgtacgttggtgacttataacctttatcttgttggtaccgacgacggacccaggccacgtcgtaccccaaactctatttcttatgtatgtacagtaactccggtccccgtagggtttctgatcgtcttctagtggacctcgtaagtctcgtcctacgacggtccctccgtacgaccctacgttcccgtaccggcctacccgtacgtccgtagggacggtaccgggaagtccgtggtaaattttacgttaagtttcggtttaaacgttccttaaagttaacgttaaaccccgtaaacccgtaggtttaaccggtaccgttaaacgggttttcgggggttacggtttccgggggaaccggggaccgggtaaacccggtcggggttacctaccggggttacccgttacccgggttagggttacccgaaccggtaaccccggaacggtccccgttcccggtaaccccccgttcggtacccgtaccgttcccgttacccggtttacccccctacccgttacccccgg

SEQ ID NO: 274928 - DNA, 653 bp, Homo sapiens
  misc_feature: GYAE6OF02HRLKS.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttaattaactttatctgttggtaccgacaggacccaggcactcgtaccccaaactcatttcttatgatgtacagtaactccgggccccgtaggggtttcagtacttccgtctttctagttcggacctaccgaagttctcgtaccctacgacccggtcccttacccgtcgaccctacgttccgtcccgggccttcccgacgtccgtaggacggaccgaggtctagtatttagttagttgttagttcattaacactaacctagtacgaccttacggttgggtcggttccgggaggacgggtaccgaggccgtacggacccgttccggtaggtccgaaccggacccgtaacggcccttcccgcccccggttcggtcctaccgtttccgtcccgttccccggccccttacccg

SEQ ID NO: 274929 - DNA, 719 bp, Homo sapiens
  misc_feature: GYAE6OF02GZALM.27.23.C01.1.454.CMB.1.raw
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (331)..(331): a, c, t, g, unknown or other
  misc_feature (331)..(331): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcgtggacagtcgatcactatctcctgcacgtcggaacccgngatcgtacgttggngtacttaattaactttntcgttggttacggtaccgacgacggacccaggcctactccgtaccccaaacttctatttactttangtattcgtactaagttaccgtccggtccccggttagggtttactggtacttcgtcttctagtcgtactaccgaagttcctacgtaccctacgaccgtccctcccgtacgacctacgtcccgtacggtccctaccgacgtccgtagggacggacggagtcgtagttaacttagttagtttagttaacttactaacttaactaactaacctaaggtaccgtaacgttacgggtttcggggtacgttaaccggggacgggtaacgggaccggtacggtccgtaccgtcccggttacgtacgtaccgaccggtaaccgacgggtcccgtaccccggtccccggttcggtacccttccgttccccggtttccgttaccccgtcccgttacccg

SEQ ID NO: 274930 - DNA, 748 bp, Homo sapiens
  misc_feature: GYAE6OF02JWNOT.27.23.C01.1.454.CMB.1.raw
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
tcagagcgtcgtctcacgaccggtgctcgatttagtacacgtgattagggattggggggggtcgtcgaggaggcagcgctctcgggacgtctccaccatggcctgggctctgctattcctcaccctcctcactcagggcacagggtcctgggcccagtctcgccctgactcagcctgcctccgtgtctgggtctcctggacagtcgntcaccatctcctgcactcggaaccctgatgacgttgtgacttataacttntntgttggtactacgacggaccaggcctactcgtaccccaactctatttcttactgtatgtactagtaacgtccgccccgtagggtttacctgtacgtcgtcttcgtacgtcgtctaccgtacgtctacggcctaccgtacggtccctcctcgtaaccctctacccgtccggaccctccgtacgcccgttagggaccggtaccgggtacggtccgttacgttaactttaagtttattacgtttacgtttacgtaataccttaacgtaaccgtaacgttacgaaccgttacggtttacggggtttacgggttccgggtacggggtaaccgggaaccggtacgggtaccgttaccgggttaacccgtaccggtttacgggtcccgtaaaccgggtacccgtaacgggtcccgttacccggtaccccccggtcccgggtacccttacccggttcccgttaccccggtttacccccggtccccctttacccccgg

SEQ ID NO: 274931 - DNA, 678 bp, Homo sapiens
  misc_feature: GYAE6OF02GY5RH.27.23.C01.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (345)..(345): a, c, t, g, unknown or other
  misc_feature (345)..(345): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcacntctctgcactggaacccngatgacgttggncttaataacttttatcttgttcggtaccgacacggacccaggcactcgtacccccaaactctatttctttatgatgtcagtaactccggcccccgtaggggtttcngtactcgtctttcgtagtcggtctaccgtaagtctcgaccctacgaccggtccctccctacgaccctagtcccgtcccgggcctccgacgtccgtaggacggtacggacggtctagtaatttatttagtttagttagtttacaagttaactaaccaaccgtaggtacgtaaccgttacgtttggggtcggttacgggacgggtaacgggtaccggaggtccgttcgggtaacccgttccgtacggtaccgaaccggtacccgaagggtcccgtcccgtacccccggtcggtacccgtaccgttcccgttacccttaccccgaccccttacccg

SEQ ID NO: 274932 - DNA, 658 bp, Homo sapiens
  misc_feature: GYAE6OF02GY530.27.23.C01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (349)..(349): a, c, t, g, unknown or other
  misc_feature (349)..(349): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggngcttaataactttatcttgttcggtaccgacaggaccaggcactcgtaccccaaactctatttcttatgtatgtacagtaactccgggaccccgtaggggttttcngtacttcgtactttcgtactcggtctactaagtctcgacctaccgacggtcctcccgtgacctagttccgtccgggtctaccgacgtctacggaggtacgaggtctagtatttattagttgttaacgtttacaactacttaaccaaaccgtagttacgaaccttacgtttggggtcgttacggggcggggtaacgggtaccgaggtcgtacggacccggttccggtacgtacggaccgacccgtaagggtcccgttacccggtccccgttacggaccttccgttccgttcccgttcccccgcccttccg

SEQ ID NO: 274933 - DNA, 719 bp, Homo sapiens
  misc_feature: GYAE6OF02GG4QG.27.23.C01.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccngatgacgttgncttataactttatctgttcgtaccgacaggaccaggcactcgtaccccaaactctatttctttatcgattgtctagtaactccggtccccgtagggtttcctgtactccgtctttcgtatcggtctccaagtcctcgtaccctacgaccggtcccttaccgtacgtacctacgttcccgtaccgggtcctccgtacgtcctacgggaacggacggtacgggtcttaggttaatttacttaacgtttaggttaacgttactaacttaactaacccgtaaacctagttacgtaacgttaccggttttaggggtcggtttaccgggacgggtaaccgggccggtaacggtccgttacgtaacccggtttaccgtacgggtacccggaccggtaacccgtaaccgggtcccttacccggtaccccccgtttacggtaccctcccgtttacccggttccctttacccccgtacccttaccccgg

SEQ ID NO: 274934 - DNA, 721 bp, Homo sapiens
  misc_feature: GYAE6OF02GFY38.27.23.C01.1.454.CMB.1.raw
  modified_base (230)..(230): a, c, t, g, unknown or other
  misc_feature (230)..(230): n is a, c, g, or t
  modified_base (270)..(270): a, c, t, g, unknown or other
  misc_feature (270)..(270): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccganacggacccaggcactcgtaccccaaactcatttctttatgatgtcaagtaactccggcccctaggggtttctgtacttcgcttctagtcggctccgaagtctcgtaccctacgaccggccctccctcgtacccagttcccgtccgggtcctcccgacgtcccgtggaacgggtacggtacggtccgtaggtaatttaacgtttagtttacggttaacgtttactaacgttaacttaaaccgtaaaccgtaggttacgtaaccgttaaccggttttggggttacgggtttacccggggaccggggtaacggggtaacccgacgggttaccgtcggtaccccgttccggtaacgggtaccgtaaccggacccgaaacgggtcccgtacccggtcccccgtaccgggttaccctaccgttcccgtacccgtttaccccctaccccttaccccgg

SEQ ID NO: 274935 - DNA, 685 bp, Homo sapiens
  misc_feature: GYAE6OF02H4LL8.27.23.C01.1.454.CMB.1.raw
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgccgtccgtgtctgggtcctccgtggacagtcgatccaccatcgtcctgctacgtcggaaccgcgatggacggttggtgtctttaataactttnttcgtgttcggtaccgacgacggacccnggccacgtcgtaccccaactctatttctttatgtatgtctaagtacgtcccggtcccccggttagggtttcgtacgtgttccggtacttcgtaggttcggaccgttacctaaggttcccttgtaccctacgtacccggtaccctccctacgaccttacgtccggtcccggtccctacgaccggtccgtacggacgggacgtaggtcttcgtaattttacgttatttggttattactattaacctacaaccgagtactacgttacggttgggttggtccgggacggggtaccgaccgtaggccgtcgaccgtccgtaggtacgcggacccgtaggtcccgtcccgtccccgtcggtacccacgttcccgttccggtcccccgcctcccgg

SEQ ID NO: 274936 - DNA, 687 bp, Homo sapiens
  misc_feature: GYAE6OF02FGZQ7.27.23.C01.1.454.CMB.1.raw
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatcctctgcactggaacccngatgacgttggtgctttataactttatctgttcggtaccgacgaggacccaggcactcgtaccccaaactcattctttangattgtcaagtaactcggtccccgaggggtttctgtactccgtcttactacgtcgacttccgaagttccttacgcccttaacgaccggtcccttaccctagaccctacgttccgtcccgggaccttcccgacgccgttcggaacggaccggaggtacctagttaactttaagttactttaagggttattactaagttaacctaaacgtaacgtaggtacgtaactacggtttagggtacggtttacgggacgggtacgggacctaggccgttacgacccggtacctacggtccgaaccggaccgaaacggtccgtaccggtccccccgttacggttaccaacccgtttccgttacccgttccccgtaccccttaccccg

SEQ ID NO: 274937 - DNA, 841 bp, Homo sapiens
  misc_feature: GYAE6OF02G1WOW.27.23.C01.1.454.CMB.1.raw
  modified_base (249)..(249): a, c, t, g, unknown or other
  misc_feature (249)..(249): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctgccctgactcagcctcgcctccggtgtccgtgggtcctccgtaggactagtcgactcaccattcctccgtgacactacgggaaaccccngtaatcggaccggtttgggctacctttaattaaccgttttattcgttggttacggtaccgaacgaacggaccccgaggaccttacgtccgtaaccccctaaaactcctaccttttacgttttaactgtaacgttcggttacaaacggttaaaccgtccccggggtaccccccgttagggggttttcctaagtacggttacccggtcctttacgtaacggttcggtcccgttaacctaaacgttccgtttaccggaccccgtaaaaccggttcccggtccccttacccgttacgggtaaccctacgttccggttcccggggacctacccgacggccgttacggggaaacggtacgggtaagtccgttagttaactttaatttacgttaggttacttaactatttaaaccaactaaccgagtagttaaccgtcggttttggggggtacgttccggggacgggttaaccgggaccaagggtcccgtaacggcccggtttactacgggccgtaaaccggcccgggaagtccccggtccgttacccccgtcgggtaccttaaccgttccctttaccccggttcccctacccgtaccg

SEQ ID NO: 274938 - DNA, 927 bp, Homo sapiens
  misc_feature: GYAE6OF02IX49D.27.23.C01.1.454.CMB.1.raw
  modified_base (242)..(242): a, c, t, g, unknown or other
  misc_feature (242)..(242): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacagtcgatccacctactcctccgtgctacgtacggaaccccgngtactcgtacggttggtcgtactttaagttaacttttgtccgttaggtttaccggtaaccggttaccaacggggtaaccccgagggtacctaaccgttaccgtacccccgtaaaacttcgttaaccttttacttttaacgtagttaagttcgttaacgtaaggttaaccggtcccggtaccccggttaagggggtttctaagtacgttccgtcgttacgtaacgtcgtaccgttaccgtaacgttccgttaccgtacccgtttaaccggaccccgggtaccctttaccccgtacgggttaaccccgtacgttaccccgggtttaccccgggtacgttaccccgtaccgggtacccgttaacggggtaccgggtaaaccggggtccggttacgttaacgggtttaacttttaaccggttttaagtttacgggttaaccgtttacgttaaacttaacccgtaaccgtaaacgttaccgggtacttaaccggttcgggtttaccggggtaggtttaccggggaacggggtacgggtaaccggtacggttaccggttaccggtaccggttacgttaccgggtaccggaaccggtacccggtacggttacccggttcccccggttaacccggtaccggttaccgttacccgttaccggtttaccccgttccccggtaccccgttacccgg

SEQ ID NO: 274939 - DNA, 703 bp, Homo sapiens
  misc_feature: GYAE6OF02I30C0.27.23.C01.1.454.CMB.1.raw
  modified_base (140)..(140): a, c, t, g, unknown or other
  misc_feature (140)..(140): n is a, c, g, or t
  modified_base (211)..(211): a, c, t, g, unknown or other
  misc_feature (211)..(211): n is a, c, g, or t
  modified_base (265)..(265): a, c, t, g, unknown or other
  misc_feature (265)..(265): n is a, c, g, or t
  modified_base (359)..(359): a, c, t, g, unknown or other
  misc_feature (359)..(359): n is a, c, g, or t
  modified_base (691)..(691): a, c, t, g, unknown or other
  misc_feature (691)..(691): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacnggtcctgggcccagtctgccctgactcagcctgcctccgtgtcctgggtctcctggacagtcgactcaccntcctcctgccactcggaacccgcgtaatcgacgtttggagtctttataactttntctgttcggtaccgacacggaccaggcacgtctacccaaactctattactttagtgtatagtcaacgtaacgtccgtaccccgtaggggtttcngtactcgtcttctatcgactctaagtctcgcctacgtaccggcccttcgactaccctagtcccgtaccggtcctccgactccgtggtacggacgtacgtcttggtatttaacgttattcggttaacttcgtaattacctaacctaaacgccgttagtaacccttacgggttggggttccgtttacgggggaaccgggacggggtaaccgtagggtccgtaaccggttacccggttaccgtaggttacccgaacggttaccccggaacgggtcccttacccggtcccccggttaccggtacttaacccgtccgttccccggtttaaccccccncccgttacccgg

SEQ ID NO: 274940 - DNA, 818 bp, Homo sapiens
  misc_feature: GYAE6OF02FR6SM.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccatgtctgggtctcctggacagtcgatcaccattctcctgcactcggaacccgcgatgacgttggtcgacttataactttatctggttcggtaccgacgaggacccaggaccacttcgtacccccaaacttcctaactttcttttaagtggtacttcgtacgaaggttaactcccgggtacccccgtaggggttttcctaggtacttcgtctttcgttagtcggccttaccgtaagtccgttcgacccgttaaccgaccggtccccttaccccgttacggtaaccctaaccgtttcccgtcccggggtacccttacccgaccggtaccccgtagggaacggggtaacccgtacggggtccttacggttaaactttaacgttttagtttaggtttaacgtttacctaaagtttaaccgtaaacccgtaaaccgtaggttacgtaacccgttacggtttacgggggttacggtttaccgggggacggggtaaccggggtaacccgtagggtccgtacggtacccggttaccggtaccgggtaccggaaccggtaccccgaaccgggtccccttcccgggtcccccccgttcgggttaccccgtacccgtttcccgttaccccggtttccccccgtacccccg

SEQ ID NO: 274941 - DNA, 808 bp, Homo sapiens
  misc_feature: GYAE6OF02HRZ38.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctggtctccgtggacagtcgatcgaccatctcctgcacgtcggaacccgngaatgacgttggtgctttaagtaactttatcgttacggttcgggtaaccgacgacggtaccccagggacctacgtccgtaaccccctaaaacgtcctaatttcctttaagtcggtagttccgttacgtaagtttaaaccgtcccgggtacccccgttaggggttttcctacggtaccgtaccggttcctttacgtaagtccggtccttaaccgtaacgttccgtaccggtacccttaaccgaccggttcccttacccgtacgaaccctacgttccgtaccggtcctcgacgtccgtagggacggtacggtacgtccgtaggtaactttaacgtttagtttacggttaacgttacgtaattaacccgtaaaccgtaacccgtaggttacgaacctttacgggtttcgggttaccggttccgggtaaccgggtacgggtaaacccgtagggtccgtaaccggttacccgttaccgtagggtaaccgtacggtaccccgaaggtacccgtacccggtacccccgttacgggttaccctacggttacccgttaccgttaccccccgaaccgttccccgg

SEQ ID NO: 274942 - DNA, 781 bp, Homo sapiens
  misc_feature: GYAE6OF02FT47Q.27.23.C01.1.454.CMB.1.raw
  modified_base (325)..(325): a, c, t, g, unknown or other
  misc_feature (325)..(325): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgcgaatgacgttgggtgtactttaataactttatcttggttcggtaccgacgacggacccgaggccacgtcgtacccccaaactctattctttangatgtcaagtactccggaccccgtaggggtttctgtactccgtcttctagtcggcctaccgtaagtcctcggaccctaacgacccggtccccttcccgtacgtacccgtacgttcccgtcccgggccttacccgacgtcccgtaggaaccggacggtacgggcttaggttactttacgtttagtttaggttaacgttacctaagtttaaacctaaccgtaaaaccgtacggttacggtaaaccgttacgggtttaccggggttcgggtttacccgggggaaccggggtaaccggggtacccgtaaacgggttcccgttaaccgggtaccccggtttaccggttaccgggttaacccggaccgggtaaccccggtaaacgggtccccggttaccccgtcccccgggttaccggtcctacccgtttccttaccggtttcccgtacccgtttccccccg

SEQ ID NO: 274943 - DNA, 684 bp, Homo sapiens
  misc_feature: GYAE6OF02IBDDP.27.23.C01.1.454.CMB.1.raw
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
  modified_base (603)..(603): a, c, t, g, unknown or other
  misc_feature (603)..(603): n is a, c, g, or t
  modified_base (664)..(664): a, c, t, g, unknown or other
  misc_feature (664)..(664): n is a, c, g, or t
  modified_base (676)..(676): a, c, t, g, unknown or other
  misc_feature (676)..(676): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcaggcacagggtcctgggcccagtctgccctgactcagcctgcctcgtgtctgggtctctggacagtcatcaccatctccngccactcggaaccccgngatggacggttgtgctttaattactttntcgttgttcggtaccgtacgacggaccgaggacctactccgtacccctaactctatttctttatagtattgtacgagttaaccgcccggtccccgttaggggtttcctaggtacttcgtactttcctacgttacggacccttacgtaacgttcctacgtaccctaccggacccggtcccctccgtacgaccgtccgtccgtcccggtacctccgacggtccgtacgggaaaccggcgtacggtgttaagttactttagttttagtagtttacgttactaagttaaaccaacctaacgtgttacgaaccgttggttgggttacgttcgggacggaagggtaccgnggactacgtccgttacgcggtaccgacgtaccgacgtcctcccgtaccgtccgtcttaccnctcccgtacccnccgtcccg

SEQ ID NO: 274944 - DNA, 696 bp, Homo sapiens
  misc_feature: GYAE6OF02JI0VR.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattggggggggtctcaggaggcagcgctctcgggacgtctccaccatggcctgggctctgctattcctacaccctcctcactcagggcacgagggtcctgggcccagtctgccctgactcagcctgcctccgtgtctgggtctacctggacagtcgatcacatctcctgcacgtcggaacccncgagtcgacggttggcgtacttatactttagtcgttgttcggtaccgtacgacgtaccgacgcactacgtacccaactactacttcttatgtactcgtactacgtaacgtccggtcccgtaaaaacgggttcgtacgtacgtcgtcttcgtacgtcgtcgtacgtacgtcgtcgtaccgtacgtaccggtcctacccgtacgtacctacgtccgtccggtaccgtccgacgtcgtacggtacggacggtacgtcgtacggttactttagttacgtttacgttacgtttactaacttacgtaacctaccgtaacgtacgtacgtacggttcgggttacggtcgggtacggacgggtaccgcggtacgttcggtaccgtacgtaccggtacgtaaccggtaccgtacggtccgtcccgtcccgtaccgtccgtaccgttccgttacccgttcccgtcccgtaccg

SEQ ID NO: 274945 - DNA, 718 bp, Homo sapiens
  misc_feature: GYAE6OF02ICJYM.27.23.C01.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacngtcgatcaccntctcctgctactggacccgngatggacgttggtgtactttataacttttntcttggttcggtaaccgacgtacggacccgaggcctaacgtacgtccccaaattctatttctttaatgattgtactagtacgtccggtccccgtaggggtttctcgtactccgtacttacgtacgtcggccttacgtaacgtcgtcgaccgttaaccgaccggttccctccctacggtaaccctacgttccgtacccggtcctaccgacgtcccgtaggacggacgtaggtacgtagtaatttacggttatttagttacgttactagtaactaaccgtaacgtacggttagtaccgttacggttcgggttacgtccggggtacggaacgggtaccgtaggtccgtaccggttaccgtaccgttacgggtccgtaccggtaccgtaacgggtccctacccggtccccgtacggtacctacccgttcggtttaccctcccccggtacttaccccgg

SEQ ID NO: 274946 - DNA, 779 bp, Homo sapiens
  misc_feature: GYAE6OF02FXEBS.27.23.C01.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
tcagagcgtcgtctcacgaccggtgctcgatttagtacacgtgattagggattgggggggggtctcaggaggcagcgctctcgggacgtctccacatggcctgggctctgctattcctcaccctcctcactcagggcacgagggtcctgggcccagtctgccctgactcagcctgcctccgtgtctgggtctccgtggacngtcgatccacattctcctgccacgtcggaaccccgngtatcggtacggttggtcgtactttaattaacttttnttcttggttcggtaccgacgacggaccgaggcctaccgtccgtaacccctaacttctacttttctttactgtacttgtacgtaacgtaaccgtcccggccccggttaaggggttctaggtacttccggtctttacgttacgtcggtacctaccgtaaacggttcctacggtaccctaccgtacccggtccccttacccgtccgtacccgtacttcccggtacccgggtccctccgtaccgtcccggtcgggtaaccgggcggtaacggtcgttagttaacgtttactttaggtttacggttagtttacctaacgttaactacccgtaaccgtaggttacgtaccgttaggtttcggggttacgggtccgggtacggtacgggtaccggtacggtcgtacccggttaccggtaccggtacggtaccgtacggaacccgtacggccctcccgggttaccccgtcgtaccgtaccgtttcccggtccccgttcccgccccgttacccg

SEQ ID NO: 274947 - DNA, 629 bp, Homo sapiens
  misc_feature: GYAE6OF02FQZDN.27.23.C01.1.454.CMB.1.raw
  modified_base (230)..(230): a, c, t, g, unknown or other
  misc_feature (230)..(230): n is a, c, g, or t
  modified_base (350)..(350): a, c, t, g, unknown or other
  misc_feature (350)..(350): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgacttaataactttatctgttcggtaccgacacggacccaggcactcgtaccccaaactctattctttagtgtattgtcaagtaacgtccggtccccgtagggtttcngtatcgtcttctatggtctaccgtaagtctcgccctacgaccggcctcccgtacgaccctactccgtccgggcctcccgagtccgtggacggacgaggctgtattattagttgttacttctatactaacactagtacgactacgttgggtgtcggacgggtacggacgaggtctacggccgttacgtacggtcgtaacggacccgtaacggtcccgtaccggtacccccgttcggttacccaccgttcccgttacccgttaccccctacccgttccccg

SEQ ID NO: 274948 - DNA, 770 bp, Homo sapiens
  misc_feature: GYAE6OF02FONDV.27.23.C01.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
  modified_base (322)..(322): a, c, t, g, unknown or other
  misc_feature (322)..(322): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtcnccgtggacagtcgatcaccatctcctgcacgtcggaacccgngatgacggttggtgtacttaataacttttatcttggttggtaccgacacggaccccaggcactcgtaccccaactctatttctttaatntagttgtcgaagttaacgtccgggtcccccgtaaggggttttctagtacgttcggttacttacttacgtcggtacctccgaaacgtcctacgacccgttaccgaccggtcccttacccgtacgtaccctacgttcccggtcccggacctcccgaacgtccgtagggaacgggaccggagggtaccttagggttaattttaacgttaagttttacgggttaacgtttaagttaaacgttacgttaaaccgaaaccgttaagggtacgtaaaccgttaacgggttttcgggttaccgggttccggggaacgggtaacggggtaacccgtaacggtccgtaaccgggacccgttaccggttaacggtaccgtaaccggacccgtaacggtaccgtcccgtccccggttcggtaccgtaccgttccgttacccggtccccgtacccgtaccg

SEQ ID NO: 274949 - DNA, 690 bp, Homo sapiens
  misc_feature: GYAE6OF02HT28B.27.23.C01.1.454.CMB.1.raw
  modified_base (234)..(234): a, c, t, g, unknown or other
  misc_feature (234)..(234): n is a, c, g, or t
  modified_base (388)..(388): a, c, t, g, unknown or other
  misc_feature (388)..(388): n is a, c, g, or t
  modified_base (450)..(450): a, c, t, g, unknown or other
  misc_feature (450)..(450): n is a, c, g, or t
  modified_base (470)..(470): a, c, t, g, unknown or other
  misc_feature (470)..(470): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtccgtgggccctagtctgccctgactcagcctgccctcgtgtcgtggtctcctaggcagtcgatcacgatctctgctacgtcggaaccgnatcgtacggttgtgtacttaataacttttatcgtggttacgtaccgaagacggtaccgacggactaccgttccgaacccctaacgttacttacgtttactttagtgtactcgttaactacgtaacgtccccgggtaccccggtttagggtttcngtaccgtcgtacgttctagcgtactacgtaacgtctacgtacaccgtcggtaccctccgtanaccgtgtccggtccggtacncgtacgcgtaggacggtacgagtcgtagttaattacgttgttaagttagttacaacgttacaacgtacgactacgtacgttacgttcgggtacgttcggacgggtcggaaccgtcggacgtaccgttccgtacgtacggaccgaacgaccggtacgtccgtacccgtccccggttacggtactacccggttaccctcccgttaccccggtacccttccgg

SEQ ID NO: 274950 - DNA, 749 bp, Homo sapiens
  misc_feature: GYAE6OF02IDEWH.27.23.C01.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctcgtgtcgtgggtctcctggacagtcgatcaccatcctcngcacgtcggaccgngatggacgttggctactttaacgttaactttatcgttggttacggtccggacgacggaccacggctactccgtacccccaaactcttaactttactttatcgtatagtactacgttaacgtccggtaccccggttagggttcctagtacgtcgttccttacgtaggtccgtacctacgtacgttaccgtccgtacccgtaccggaccgttccccgttaccgtaaccgtacccgttacgttcccgggtcccgggtaccctacccggtaccgtcccgggtagggaaacccggtcggtacgggtaccgttagttaacgtttacgtttagtttacgttaacgttactaacgtttaccaaacgtacgtacgttacgtaaccgttacgggttgggttcggtacgggtacgggacgggaaccgtacggaccgtcgggtacccgtagtacggccgtaacgccggaacgtccctccggtacccggttcgtaccgtccgttaccggttcccgtcccgtacccgtaccg

SEQ ID NO: 274951 - DNA, 675 bp, Homo sapiens
  misc_feature: GYAE6OF02JASEV.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgccctccgtgtctgggtctcctggacagtcgatcaccatctcctgcactggaaccccngatgacgttggngcttaataactttntctgttcgtaccgacaggacccaggcactcgtacccaaactcattctttatgtatgtcaagtaatccggcccctaggggtttcagatcgtctctatggctacagtctgcctacgacgtccctcctacgacctagtccgtcccgggtctcccgacgtccgtacggacgggaaccgaggtctaggtaattttacgttaagtttcgttaacggttttcaacgttaactaaccgtaaacctaggttacgaacgttaacgtttggggtacgtttacgggacgggtacgggaccgtacggcgtacgtacccggtaccgttacggtaccgaacggtaccccgaaagggtcccgtaccggtacccccgttaccgggttccgtaaccgttcccggttacccgtttacccccggtaccccgttaccccg

SEQ ID NO: 274952 - DNA, 738 bp, Homo sapiens
  misc_feature: GYAE6OF02JB3SO.27.23.C01.1.454.CMB.1.raw
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatcctcctgcactcggaacccncgatgacgtttggntcttaataactttntcttggttcggtaccgacgacggaccaggcactcgtacccctaaactctactttctttatgtattgtacgtagtaacgtccgggtccccgtaggggttttctggacttccgtctttctagtcgtaccctaccgtaacgtctcgtacccttacgacccggtcctccctacgacctacgtccgtccgggctacccgacgtaccgtcggaacggtaccggtacggcttacggtatttacgttttacgttaggttaacgtttactaagtttaactaacccgtaaacgtacggtacgttaaccggttacggttttggggttacggttcggggaccgggtaacgggtacccggaggtccgtaccggtacccggttaccggtacggtccgaaccggtaacccggtaccggtccggttaccccgtcccccggttacggttaccctaccgtttcccggtacccggttcccccgtccccgttacccg

SEQ ID NO: 274953 - DNA, 612 bp, Homo sapiens
  misc_feature: GYAE6OF02FK06S.27.23.C01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccccngatgacgttggtgcttataactttatctgttggtaccgacaggacccaggcactcgtccccaaactcattcttatgatgtcagtaactccggcccccgtaggggtttctgatcgtcttctatggtctaccaagtcctcgcctacaccgtccctccctgacctatccgtccgggcctccgacgtcctggaacgggaccgacggctagtatttagttagttagttagttactattactaacaactagtcgaactacggttgggtcgttcgggacgggtacgggaccaggcttacggaccgttccgtaggtccaaccggacccgaacggcctccggtcccccgttcggtccctaccttccgtcccgttccccacccgttacccg

SEQ ID NO: 274954 - DNA, 776 bp, Homo sapiens
  misc_feature: GYAE6OF02GAK9H.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattccctcaccctcctcactcaggcacagggtcctgggcccagtctcgccctgactcagcctgcctcgtgtcgtgggtcctcctggacagtcgatcacctatctcctgactaccgtcgggaacccgcgatcggtaccggttggtctacttaattaacctttgtccttggttacggtaaccggacaacggtaccccgacggactaaccgttcgtacccccaaaacttcctaacttttaccgttagttagtagttccggtacgtaacggtaaccgttccccggggtacccccgggttaagggggttttccctaggttaacgttccccggttaactttacgttaacggttcggtacccttaccgtaacgttccgtacggtacccccttaaccgccggttacccccttcgtaccgtaccctacgtcccgttcccggccgtaccgaccgcgttggaccggtacgacggtcgtacgttacgttagttagttcggttaacttacgaattaacctaacctaaccgtagtaaccgttactacgggtttaccgggtggttcgggtaccgggtacggacggtaggccgtacgtaccgttacgtaacggcgaaccggtaccgacgtaccgccggtacccgtcgtacctccgtccggttcctccccgccttacccg

SEQ ID NO: 274955 - DNA, 804 bp, Homo sapiens
  misc_feature: GYAE6OF02JTHYK.27.23.C01.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
tcagagcgtcgtctcacgaccggtgctcgatttagtacacgtgattagggagttgggggggggtcgtcgaggaggcagcgctctcgggacgtctccaccatggcctgggctctgctatcctcacctcctcactcaggcacaggtcctgggcccagtctgccctgactcagcctgcctccgtgtctcgggtctcctggactcgtcgaatccaccagtctccgtgccacgtgacccgngatcgacgttggcnttatacgtttatcttgtacggtcacacggtaccagcactcgtacccaacgtcacctttcttanagttntcgtacgaagttaaccgtccggaccccggttaaggggttcctaggtactccggttccttacttaggcgtcgttaccctaagttccgtcaaacccgttcggaccggtccccttacccgtagaccttaccttcccgggtccggttacccgtaccctacggtacccggtacgggttaccgggaacccgtacggttacgtttacgttaacgttttaacgtttaacgtttaggttaacggttttaccgtaattaaaccttaaccgaaaccgttaacgtttcggaaccgttaaggtttccggggtttaacggttccgggggacggggtaaccgggtaccggtacggttaccggtaaccgtcccgggtttacgtaccgggtttaccgaccgggtaaacccggttacggtacccgtttccccggacccccggttttacgggtaaccccgttcggtaaccccggttttccctaccccccggttaccttccccggg

SEQ ID NO: 274956 - DNA, 639 bp, Homo sapiens
  misc_feature: GYAE6OF02GHUOF.27.23.C01.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (372)..(372): a, c, t, g, unknown or other
  misc_feature (372)..(372): n is a, c, g, or t
  modified_base (543)..(543): a, c, t, g, unknown or other
  misc_feature (543)..(543): n is a, c, g, or t
tcagagcgtcgtctcacgaccggtgctcgatttagtacacgtgattaggggattggggggggggtctcaggaggcagcgctctcgggacgtctccaccatggcctgggctctgctattcctcaccctctcactcagggcacgagggtcctgggcccagtctgccctgactcagcctgcctccgtgtctgggtctcgtggacngtcgatcaccatctcctgcacgtcgggaacccgngtatggtacggttgggtcgtactttaattaacttttatccttggttacggtacccgacgacggacccgaggcactcgtacccccaaatctatttcttatgatgtactagtaacgcccggtccccgtaggggtttcngtacgtcgtcttctgtcggtactccgtagtctcgccctacgaccggtccctcctcgaccgtactccggtccggctccacgccgtacggagggtacggacgtctaggtattagttattggttacttataatactaacactagtcagtcgttgggtcgtcgggacggacggcncggtacgtcgtacccgtgtacggtaccacggtacccggaggtcccgtaccggtccccgtacggttcctaccgttcgtacccgtcccctcccctacg

SEQ ID NO: 274957 - DNA, 670 bp, Homo sapiens
  misc_feature: GYAE6OF02GS7PO.27.23.C01.1.454.CMB.1.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
tcagagcgtcgtctcacgaccggtgctcgatttagtacacgtgattagggattgggggggggtctcaggaggcagcgctcgtcgggacgtctccaccatggcctgggctctgctattcctcaccctcctcactcagggcacagggtcctgggcccaggtctgccctgactcagcctgcctccgtgtctgggtctccgtggacagtcgatcaccactctcctgcactggaaccccngatgacgttggtnacttataactttntctgttacgtacgacacggacccaggcactcgtaccccaaactcatttacttatgatgtcaagtaactccggtaccccgtaggggtttcagtctccgtacttcgtatcggctactaagtctcgacctacgccgtccctcctacgacctacgtcccgtccggcctacccgacgaccgttggaacgggacgacggcgttagactttaattagttacggttactttacaagttaacctaactaaccgtaggttcgtactaccggtttgggttacgtccgggacggtacgggaccgacgggtcgttaccgccgttacgtacgaccgccggacccgtaacggtcccgttaaccccgtccccggttacggttaccctacccggttccttcccgggttcccccgtcccttaccccg

SEQ ID NO: 274958 - DNA, 733 bp, Homo sapiens
  misc_feature: GYAE6OF02J172J.27.23.C01.1.454.CMB.1.raw
  modified_base (358)..(358): a, c, t, g, unknown or other
  misc_feature (358)..(358): n is a, c, g, or t
  modified_base (484)..(484): a, c, t, g, unknown or other
  misc_feature (484)..(484): n is a, c, g, or t
  modified_base (559)..(559): a, c, t, g, unknown or other
  misc_feature (559)..(559): n is a, c, g, or t
  modified_base (566)..(566): a, c, t, g, unknown or other
  misc_feature (566)..(566): n is a, c, g, or t
  modified_base (633)..(633): a, c, t, g, unknown or other
  misc_feature (633)..(633): n is a, c, g, or t
tcagagcgtcgtctcacgaccggtgctcgatttagtacacgtgattagggagttggggggggtctcaggaggcagcgctcgtcgggacgtctccaccatggcctgggctctgctatcctcaccctcctcactcgagggcacgacgggtcctcggcccagtcctcgccctgactcacgcctgccttcgtgtcgtggtcctcgaggactacgtcgactctacctactcctcctcgaccacggtaccggaacccgtgtacgtcgtacgttggtctactttaaacgttaccttgtacgtaccggttacggaaccacggaacccggtccgtagaccttaccccgttaccgtaaaccctaattnttaacttttacggattacggaacttcggtaaaccgtacggttacccggtccgtaacccgggttggtctactacgtcgttactcgtagtccgaccttacgcgtacgtcccaactccgtcccgttacnccgtcgacccttcgccggtccaccgtacgacgtcggtgaaccggtcacgttactattacgttatacttacgttanaacctanaccgtatacggtctacgtacgggttggtccggttaccgggcggtaccggtaacgcttcccgggtacnccgggtaaccttcgggacccttaacgcccggtacgaccgtccgttacccggtaccttccggcccttacgttccccgtacccggtcccgtaccgtacccgg

SEQ ID NO: 274959 - DNA, 736 bp, Homo sapiens
  misc_feature: GYAE6OF02JFJVP.27.23.C01.1.454.CMB.1.raw
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtcggaacccgcgatcggtacgttggtntacttaataactttntcgttgttcggtaccgacgacggacccaggccacgtcgtaccccaaactctactttcttaatgtatcgtacagtaacgtcccggtaccccgtagggtttctgtacttccgtctttacgtacgttcggtacctaccgtaacgttccgtcgtacccgtaaccgaccggtcccttcccgtacgaccctaccgttcccggtcccggtcctaccgacggtccgtagggacggacggtacggtcttacgttatttatttagttacggttacgttactaacgttactaaccgtaaccgtagtaccgtacttacgggttacgggtcggttaccgggacgggtacggaaccgtacgggtcctaccgggtacccgttacggttacggtaccgtaacccgggtaccgtaacggtcccgtccccggtccccgttacggtacccgttcccgttacccgttcccgttaccccctaccccgtcccgg

SEQ ID NO: 274960 - DNA, 763 bp, Homo sapiens
  misc_feature: GYAE6OF02G05SF.27.23.C01.1.454.CMB.1.raw
  modified_base (265)..(265): a, c, t, g, unknown or other
  misc_feature (265)..(265): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgccctccgtgtctgggtctcctggacagtcgatccacatcctcctgcacgtcgggaacccgcgagtgtacgttggtgtcttattaactttntcttggttcggtaccgacgacggacccaggccactccgtaccccaactctatttcttatgtagtgtacgtaagtacgtcccggtccccggtaggggtttcctagtacgtcgtacctttcgtacgtcggtaccttaccgtaacgttccgtacgtaccctacccggtacccggtcccctacccgtacgtaccctaccgttcccggtacccgggtccctacccggtacggtcccggtaggtaaccggggtaccggtacgggttaccgttagttaacgttttactttaggtttaacggttagtttaacctaacgtttaactaacccgtaaaccgtggttaaccgtaccgttaccgggttttgggggttaccggtttcggggacggggtaaccgggacggtcggtacgttccggtaaccggttccgtacgtacccggacgtacccggtaacggtccgtcccgtcccgtacggtcctaccgtccgttcccgtcccctccctccg

SEQ ID NO: 274961 - DNA, 775 bp, Homo sapiens
  misc_feature: GYAE6OF02IMLQ6.27.23.C01.1.454.CMB.1.raw
  modified_base (246)..(246): a, c, t, g, unknown or other
  misc_feature (246)..(246): n is a, c, g, or t
  modified_base (543)..(543): a, c, t, g, unknown or other
  misc_feature (543)..(543): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggactaggtcgatccaacctatcctcctgccaccgttcgggaaacccccgngaagtcgaccggtttgggtgtaccgtttaaattaaacctttattccttggtttacggtaacccgacgtaacgggaccccagggaccaccgtacgtaccccccaaaactcctaattttacctttaagtgtagttcgacgttaaggtaacgttccccgggacccccggttaaggggttttccaggtacgttacgtccttttacgtagttcggtacccttacgtaacggttccttacgaccctacggaccggtcccttaccctacgaccctacgtccgtcccgggctacccgacgtaccnggacggaacgagtctagtattagtttagttggttacttacgtaattaactacgtaaacctagtacgagttaccgttagggttacgtcggggaccggtaacgggactaacggtccgtagggtacccggttacgttaacggtacccgaacggccccgaaagggtccccgttacccggcccccgttacggttcctacccgtttacccgtccccgtttacccccgacccttaccgg

SEQ ID NO: 274962 - DNA, 781 bp, Homo sapiens
  misc_feature: GYAE6OF02GHUBZ.27.23.C01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcacgtcggaacccgngatgtacggttggtcgtactttaattaactttatcttgttcggtaccgaacacggacccaggcacctcgtaccccaaactctactttctttatcgtattacgtactaaggttaaccgttccccgggtaccccgttaagggggttttcctggtacgttccgtacctttcgtagttcggtaccctactaacgttcctcgtacccgtacctacccgggtcccttcccgtacgaacctaccgttcccggtaccgggtacccttcccgacggttcccgtacgggaacggggtaccggacgggtcgtttaacgggttaacttttagtttacgttttaggtttaacgtttactaaacgttaacttaaccgtaaacctagggtacgttaacggtacgggtttagggttccgggttcgggaacgggtacggggaccggtacggtccgtacgtacccggttacgtaggtaccgaaccggtaaccgacgggtccctaccggtccccgttacggtaccgttaccgttcccgttacccgttccccgtacccgttacccg

SEQ ID NO: 274963 - DNA, 668 bp, Homo sapiens
  misc_feature: GYAE6OF02I7DT1.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacctatctcctgcactcggacccngatgacgttggancttatacgtttancttgttagaccgtanacgaccgagcacgtctacccaatcattacttangatntcagtaacnccgtcccgtagggttcnggtactcgtattcatcggctacgtaagtcgtacgacctacgaccgtccctcctacgaacctcgtccgtccggctaccgacgacgttagggacgacgtacgttcgtaagttatttaagttatttacggtattaccaattaactacaaacctagttacgaaccgttagggttcggtcgggttacggaccgggtaacggtaccggtaggtaccgtaccggtaaccgtacccgttaaggaacccgccggtaacccgaacgggttcccgttaccccggtacccccgtttacggtacccgtaccgttccccgttaacccgtcccccgtaccccttacccgg

SEQ ID NO: 274964 - DNA, 752 bp, Homo sapiens
  misc_feature: GYAE6OF02HJPCG.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactacggaacccgngatggtacggttggtcgtctttaattaactttattcgttgtttacggtaccgacgacggaccccgaggtccacgtccgtacccccaaactctactttactttatgtattcgtactaagtaacgtcccgggtaccccgtaggggtttctaggtacttcgtcttctagtcggtctacctagtctacgaccctacgtaccgtccctaccgtacacctacgtcccggtcccggtaccgtccgacgtccgtagggaacggacgggtacgtcgttaggttatttaagtttagtttacggttacgtttactaaacgttaacctaaaccgaaccgtaaggttcgttaacgttaccggggtttaggggttcggttacggggtacggggtaccgggtaaccggtacggtccgttacgggtacccgttccgggtaacggtacccgtacgggaacccgtaacggtcccgtcccggtcccccggttcggtacccttaccgttcccgttcccggttcccccgtccctacccgg

SEQ ID NO: 274965 - DNA, 804 bp, Homo sapiens
  misc_feature: GYAE6OF02I0RTC.27.23.C01.1.454.CMB.1.raw
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttaattaactttatctgttcggtaccgacgaggacccaggcactcgtaccccaaatctatttactttactagacttgtactaacgttaatcccggacccccgtaggggttttctcgtatccggtctttctaagtcggtacctaccgtaacgtcgtacgtccctaacgtaccggtccccttcccgtacggaccctaacgttcccgtacccggggtcctaccgaccgtacccgttagggaacgggtaccggaacgggtcttacggtaattttacgtttagtttacggttacgtttactaacgttaactaacctaaacccgtaaggttacgaaccgttacggtttacggggttacggtttaccgggggtaccggggtaacggggtaacccggaacgggttcccgttaacggttacccccgggttaccgttaacggggttacccaacccggggaccccgtaaaacggggtccccgttacccgggaccccccccggtttacggggttacccctaaacccggttccccgtttaccggtttacccccccctaaccccgtttccccg

SEQ ID NO: 274966 - DNA, 708 bp, Homo sapiens
  misc_feature: GYAE6OF02IJVJ1.27.23.C01.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacagtcgatcacntctctncacgtcggaacccgngatcgtacggttggtgtactttaattaacttttntcgttaggttcggtacccgacgtaacggacccaggccacgtaccgtacccaaactctatttcttatagacttcgtactaggttaccgtcccggtccccgttaggggtttcncgtacgtccgtctttnacgttacgtccctacgtactcgtcgaccgtcgacccggtcctaccgtacgacctacgttcccgtcccggtctctacgacgtagtacggacggacggtacggtcgtacgttatttacgtttacgttacgtttacgttaacgtattaaaccctaacgtaacgtaagttaccgtaacggttcggtttaggggtcgggtaccgggtacgggtacccgggacgtaccggtcgtaccgtacccggtcgtaccggtacgaccgaccgtacggtccctacccgtccccggttaccgtgtaccccgttctcccggtaccctaccccg

SEQ ID NO: 274967 - DNA, 754 bp, Homo sapiens
  misc_feature: GYAE6OF02FWCR6.27.23.C01.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacngtcgatcacctatcctcctgacacgtcgggaaccccgngtaatcggtaacgtttgggtcgtactttaattaactttatccttggttacggtaccgacgtacggacccgaggcctaaccgtcggtacccccaaacgtctactttaccttttagtgagttcgtactaagtaactccgggtacccctaggggtttctgtaactccgtcttacgtacgtacgtccgtacctaagttccgtacgtaccctaacgacccgggtccccttacccgtacgtaaccctacgttcccggtacccggtccctacccgtacggtccggttaccggaaacggggtacccggagggtccgttacgttaacgttatttaacggtttacgttaagttactaacgttaaccgtaaaccgtaaccgtagaccgtaacgttaggttcgggtcggttacgggcgggtacggtaccgacggtcctacggtaccgtccgtaaggtccgaccgtaccggtacgacccgttccgaccccgtggtacccgtcttccggtacccttccccgtactacccgg

SEQ ID NO: 274968 - DNA, 861 bp, Homo sapiens
  misc_feature: GYAE6OF02IW3LJ.27.23.C01.1.454.CMB.1.raw
  modified_base (342)..(342): a, c, t, g, unknown or other
  misc_feature (342)..(342): n is a, c, g, or t
  modified_base (843)..(843): a, c, t, g, unknown or other
  misc_feature (843)..(843): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcacatcctcctgccacgtcggaacccgcgattggtacgttggtgtcctttaattaactttatcgttggttacggtaccgtacgacggacccaggcctacgttccgtacccctaaactacttactttctttacgngtacttgactagtaacgtcccggaccccggttagggttactagtactcgtcgttactagtcgtaccttactaacgtctacgaccgtaccgaccggtaccctccgtacggtaaccttaccgtacccggtcccgggtacctaccccgacggtcccgtaacggggtaaccgggtaccgggaacgggttaccgttaacggtttaaccgtttttaaagttttacgggttttacggttttaaaccggtagtttaaacgttaaacgttaaacccgtaaacccttaacgggttaacggtaaaccgtttaccgggttttcggggggtttacgggttacccggggggtaacggggtaaccggggtaaacccggtacgggtaccggtttaaccgggtacccgttaccgggttacggtacccggtaaccggtacccgtaaccgggtccccgtacccgggttccccccggttcgttaccctaacccgttttcccggttaccccggtttaccccncccccggttaaccccggg

SEQ ID NO: 274969 - DNA, 706 bp, Homo sapiens
  misc_feature: GYAE6OF02HYXXR.27.23.C01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
  modified_base (344)..(344): a, c, t, g, unknown or other
  misc_feature (344)..(344): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctgacngtcgatcacatctcctgcactggaaccngatgacgtttggtgctttataacttttntcttgttggtaccgacaggacccaggcactcgtaccccaaactctattctttatgatgtcagtaacgtccggaccccgtagggttttcngtactctcttctagtcggcttccaagtctcgtcctaacgaccggtccctacccgtcgaccctacgtccgtccgggtcctaccgaccgtctcgggaacgggaaccggtaggcttaggtaactttaagttttacgtttgtttaacgttactaacttaactaacctaaacgtacggtacgtaccgttacgggtttacgggtacggtttcgggaacgggaacgggtaccgtaagggtccgtacggtaacccgttaccgttacgggttaccgaaccggtacccggtaaacggtcccgtacccggtacccccgttcgggttaccctaccgtttcccggttcccgtttccccccggtcccttaccccgg

SEQ ID NO: 274970 - DNA, 741 bp, Homo sapiens
  misc_feature: GYAE6OF02HIVDF.27.23.C01.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
tcagagcgtcgtctcacgaccggtgctcgatttagtacacgtgattagggattgggggggggtctcaggaggcagcgctctcgggacgtctccacatggcctgggctctgctattcctcaccctcctcactcagggcacagggtcctgggcccagtctgccctgactcagcctgcctccgtgtctgggtcctcgtggacngtcgatcacatctctgcactcggaccngatgacgttgntcttaatacttntntgttcgaccgacgacgaccnggcnctcgtacccaatctatttacttagtntattgtacagtacgtccggtacccgttagggtttcngtactcgtacttacgtagtcggtctacgtacgttcctcgaccctacgaccgtcctcccgtacgaccctacgttccgtcccggtctaccgacgtccgtacggacggtacggtacgtcgtagttaacttagtttagttacgttacgtttctaacgttaaccgtaaccgtaaaccgtaggttaccgtaccggtttacggtttacgggggttcggtaccggggtaccgggtaacgggaacccggttacggtaccgttaccggtacccggttaccggttaaccggtacccggtaaccggtaccccggtaaccggttcccggttaccccccggttaccccggttacccggttaccccgttacccggtttccccggttccccggtttcccccgtaccccggttaacccgg

SEQ ID NO: 274971 - DNA, 840 bp, Homo sapiens
  misc_feature: GYAE6OF02JYPCR.27.23.C01.1.454.CMB.1.raw
  modified_base (136)..(136): a, c, t, g, unknown or other
  misc_feature (136)..(136): n is a, c, g, or t
tcagagcgtcgtctcacgaccggtgctcgatttagtacacgtgattagggattggggggggtctcaggaggcagcgctctcgggacgtctccaccatggcctgggctctgctatcctcaccctctcactcaggcanagggtcctgggccagtctgccctgactcagcctgcctccgtgtctgggtctccgtaggacagtcgactcacctatcctccgtagacctacgtcgggtaaccccctgaattcggaaccggtttggggtctactttaacttaacgttttactcgttcgttacggttaaccgacgtaacggtacccgtaaggtccgtacgtccgtaaccccgtaaactccgtactttacttaacgtgtacgtacgtacgtaacgtaaccggttcccggtaccccggtttaacgggggtttccttaggtaaccgtccgttacgtttaccgttaaccgttccgggtacccgttacccgtaaacgtttcctaccggtacccgtaaaccgtcccgggtacccttacccgtaccgtacccgttaacccggttcggtccccgtcctacgttaaacccggccggttaacgggaccggttaacccgggtaacggttccgttaacggtacttttaaccgttaagttacggttaacgtctaacgttactaaacgtaccgtaacggtacgacgttacggttacgggttccggttacgggaccgggttaacgaaccgtcgggtaaccgtacgggtaccttcggtaaccgtcggaacccgttaggtaccgtcgtcccgtaacccggtcgtttacgtacccttccggtacccttacccggtaccctaccgg

SEQ ID NO: 274972 - DNA, 718 bp, Homo sapiens
  misc_feature: GYAE6OF02JL5M8.27.23.C01.1.454.CMB.1.raw
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
tcagagcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccntctcctgcactcggaacccncgatgacgttggtcgcttattaactttntatgttggtaccgacacggacccaggcactcgtacccgaaacctctacttactttacttgagttcgtcacgtaagtaccggcccccgtaggggtttcctgtacgtcgtcgttcttagtgtcctcgtaatctgtcctacgccgtccctcccgttacgacctaacgtccgttcccgggtccgtcccgacgtacccgtacggtacggggtaacccgggtacggtcgttacgttaagtttacctttaatttccggtttaaggtttacctaatttaacgtaacctaaacccgtacggtacgtaaccggtacgttttacggggttcgggtttaccgggcggggtaacgggtaccggtacggacggttacgtacccgttccggtacgtccgtaaccggacccgtaaagggccttccggtcccctccggtctaccgttccgtaccgttccccgtccccgttacccg

SEQ ID NO: 274973 - DNA, 730 bp, Homo sapiens
  misc_feature: GYAE6OF02IJA7X.27.23.C01.1.454.CMB.1.raw
  modified_base (267)..(267): a, c, t, g, unknown or other
  misc_feature (267)..(267): n is a, c, g, or t
  modified_base (719)..(719): a, c, t, g, unknown or other
  misc_feature (719)..(719): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgcgatcggtacggttggtcgtactttattaaactttntcgttaggttcggtaaccgacgtacggacccgaggctacctcgtaccccaaactctagttctttatgagttgtactagttaaccgtccggtacccccggttagggtttctgtactcgtacttactagtcgtcctacagttacgtcgtacctaccgaccggtccctacccgtacgtacctacgttcccgtcccgggtcctaccgacgtcccgtagggaccggtacggagtaccgtagttaatttacgttagtttacggttacgttactaacttaacttaacgaaccgtaggtaccgtaaccgttacggtttcggggttacggttaccgggacgggtacgggacgtacggtccgtacgtacccgttacgtacggaccgtaaccgaccggtaacgggtaccgtccccggtaccccggttcggtaccctaccgtttcccgttaccgttaccccccncccgttacccg

SEQ ID NO: 274974 - DNA, 754 bp, Homo sapiens
  misc_feature: GYAE6OF02ILX0P.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctctgcactcggacccgcgatgacgttggtcgcttattaactttatctgttacggtaccgacacggaccaggctactcgtaccccaaactctatttctttatgtatagtctagtaacgccggtaccccgtaggggtttctgtacttccgtctttcgtagtcggtacctaccgtaagttcctcgtaccctaccgtaccggtccctaccccgtacgtaaccctacgtccgtccccgggtacctcccgacggtcccgtagggaccgggtaaccggtacgggtaccgttaggttaaccgttttaagttttaacgtttacggtttaacgtttactaagttaaaccgttaacctaaaccgtaggttaacgtaaccgtacgggttttacggggtcggtttaccggggaacggggacgggtacccgtagggtaccgttcggaacccggttccgtacgggtccgtaaccggaacccgtacgggtcccttacccgggtcccccgttacggtacctacccgttcccgttcccgtttacccccgaccccttcccgg

SEQ ID NO: 274975 - DNA, 757 bp, Homo sapiens
  misc_feature: GYAE6OF02GAMVJ.27.23.C01.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (345)..(345): a, c, t, g, unknown or other
  misc_feature (345)..(345): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtcttggtctcctggacagtcgatcaccatctcctgcactggaacccngatggacgttgngtcttataacttntctgttcggtaccgacacggacccaggcactcgtaccccaaactctattctttatgtatgtacaggtaactccggtccccgtagggtttcngtactcgtcttctagtcggtcctaccgtaagttcgtcgtacccgtaccgaccgtcccttcccgtacgtaccctacgttcccgtcccgggtacctacccgacggtccgtacgggacgggtaccgacgggtaccttacggtaacttttaacgtttagtttacggttaacgttacttaagttaaccttaaccgtaaacccgtaggttacgaaaccgttacgggttttggggttaccggggtttaccggggaccgggtaaccggggtacccgtaacgggtccgttaccgggacccgttacccggttacggtaccgtaaccggaaccccggtaacgggtcccctccccgggtaccccggttaccgggttaccctaccgtttaccccgtttcccggttccccccgtacccgttccccg

SEQ ID NO: 274976 - DNA, 890 bp, Homo sapiens
  misc_feature: GYAE6OF02F5XR5.27.23.C01.1.454.CMB.1.raw
  modified_base (206)..(206): a, c, t, g, unknown or other
  misc_feature (206)..(206): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcgagggcacgagggtcctgggcccagtctgccctgactcacgcctgcctccgtgttcgtgggtctccgtggacgngtacgatcaacctatccgtcctcgacctacgtaccggaaccccggcgtaagtcggttaacggtttgggtcgttacttttaaagttaaaccttttagtccgtttggttaccggtaaccgaccgtaacggaccccgaaggcctaaccgttcccggtaacccctaaacgttccttaacgttttacctttaagtcgttacgttacgttacgtaaggttaacccggtccccgggtaacccggttaggggttttcaccggttaacgtccggttactttaacgtggtaccggtacccgttaaccgacggttcctaccggaaacccgttaccgtacccgggtcccccttaccggtactaaccgtaaccgtcccggtcccgggtacttacccaaccgggtaccgtagggaacccgggtaacgacggttactagtttaacgtttaacgtttacggtttaacggttaacttacgttaaacttaaccgtaaaccctaacggttaccggtaactttaaacgggttccgggtttagggttccggtaccggggtaacggggtaaccggtacctaccgggtacttccgggtaaacggttcccgtaagggtcccgaaaccggaccgtaaccggtcgtacccccggtcggttaacccgtccgtaccgtttacccggtacccgttcccctacccggtccccgg

SEQ ID NO: 274977 - DNA, 743 bp, Homo sapiens
  misc_feature: GYAE6OF02JA1TP.27.23.C01.1.454.CMB.1.raw
  modified_base (234)..(234): a, c, t, g, unknown or other
  misc_feature (234)..(234): n is a, c, g, or t
  modified_base (710)..(710): a, c, t, g, unknown or other
  misc_feature (710)..(710): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcacgcctgcctccgtgtcgtgggtctccgtgacagtcgatcacatctcctgcactcggaacccgngagtgacggttggtcgtacttaagttaactttatcgttggttcggtaaccgacgaccggacccaggcctacgtccgtaccccaatctatttctttagtgtatgtcgtaactaccgtcccggtaccccgttaggggtttcctagtacgttccttcgtttacgtacgttcggtacctaccgtaagttcctacggaacccctttaccgacccggttcccctacccgttaccgaacccgtacgttccccggtcccggtaccacccgtaccgtcgtacgggaaccggtacgggtacgtcgtaaggttacttttaagttcgtttagttacgtttactaacgttaactaaccgtacggtacgtacggtaacgttacggttcgggtacgggttccggacgggtacggtaccgcggtaccgtcggtaccgtaccgtacggtccgtaaccgaccggtccgtcccgtccgtacccccgtgttacccnccgttacccgtaccccttaccccgtctacccgg

SEQ ID NO: 274978 - DNA, 726 bp, Homo sapiens
  misc_feature: GYAE6OF02INZDF.27.23.C01.1.454.CMB.1.raw
  modified_base (354)..(354): a, c, t, g, unknown or other
  misc_feature (354)..(354): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgcgatgtacgttggtgtcttaataactttatcttgttaggtaccgacgacggacccaggccacgtcgtacccctaactctatttcttatgtatgtcagtaacgtccggtcccgtagggtttcngtactcgtcttcgtacgtcgtctcctaagtctcgtacccgtacgtaccggtccctacccgtacgaccctacgtcccggtcccgggtcctacccggcgtaccgtcgggaacgggacggacggtcttaggtatttaacgtttagtttagttacgtttactaacttaactaaccgaaccgtacgttacgtaaccgttacgggtttcggggttacggggttaccgggacggggtaccgggtaaccggtacggacccgttaccggtacccggttacgttaaccggtaccgtacccggtacccgtaaccgggtcctcccggtacccccgttcggtaccttcccgttaccggttcccgttaccccctacccgttacccg

SEQ ID NO: 274979 - DNA, 848 bp, Homo sapiens
  misc_feature: GYAE6OF02GLVGM.27.23.C01.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctgacngtcgatcaccatctcctgcacgtcggaaccccgngacgtgtacgttgggtcgtacctttaagttaaacttttattccgttggttaccggtaaccgacgtaaccgggacccaggccaccgtcgttacccccaaacttctaatttctttaagcgtaacttcggtactaaggtaaccgtccccgggtaccccgtaggggtttcctagtcgttacgtctttacgtagtcggtcctacgtaagttcctacgtaccttaccggacccggtccccttacccgtaccgtaacccgtacgtttccccgggtcccgggtacccttacccgggacgttaccccggtaggggaaacccggggtacgtaacgggttccgtaaagtttaaacgtttacgttttacggtttaagtttacggttaacctttaaataaccttaaaacccgtacctaagggttacccggttaactttaccgggttttcgggggttaccgtttacccggggggaagggtaccggggaccggtaacggtcggtaacgttacccggtttccgaacgggttcaacccgggttacccggaaccggttcccgtccccggtacccccggttacggtacccttaccgtttccccggtcccgtttacccccggtacccttccccggg

SEQ ID NO: 274980 - DNA, 724 bp, Homo sapiens
  misc_feature: GYAE6OF02FKF3E.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcacatctctgcagtcggacccgngatgacgttggntcttaatactttatctgttcggtaccgacaggaccaggcacgtcgtacccaaactcactttactttatacgatgtctaagtaacgtccggtaccccggtagggttttctgaacgttcgtacttacgttacgtcgtctacgtaacgtctacggtccctacgaccgtccctcccgtacgtaccgacttccgtcccgggtctacccgaacgtccgtacggaacggaaccgcggtcctagtatttaagttatttaggttacgttactaagttaactaacccgtaacgtaggtactacgtacgttttggggtacgttacggggacgggtaaccgggtccgtaacggtccggttaaccggtaccggttaccggttacggtacccggtaaccgggacctaacgggtccccggttaccggtccccccggttaggtaccccgttaacccgttcccggtttacccgggtaccccccttcccgttaaccccgg

SEQ ID NO: 274981 - DNA, 918 bp, Homo sapiens
  misc_feature: GYAE6OF02IEL0L.27.23.C01.1.454.CMB.1.raw
  modified_base (245)..(245): a, c, t, g, unknown or other
  misc_feature (245)..(245): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgacgggtcctgggcccaggtctgcccctagacctcagcctgcctccgtgtctgggtctcgtggacagtcgatccacatcctactgacctacgtacggaccccgngtagttacgtaccggtttggtcttactttaacttaacttttatcgtttaggttaccggtacccgaacggaccggtaacccgaggtaccctaccggttacccgtaaccccctaaacgtccctttaatttcccgtttaagtaccggttattacggtaccgtaacgggtttaaccgtcccccggggtaccccgggtttaggggtttctacggtacgttttacccggttctttaaccggtacgttaccggttaccccttaccggtaacgttacccggtcccgttaaacccgttaccggtacccccgtaccccgtacccgtacggtaacccccttccggttaccccggtttacccggggtacccttaccggtaccggtacccgggtacgggtaaacgggtaccgggaccggttacgtttaacgtacgttttaacgttttacggttagttaaccgttacccttaataaaccgttaaccgtacgtacggtacggtttaaccgttaggggtttcggttacggggtccgggtaacggggaccgggtaacctcggtacgttaaccgggtcccgttacggaccggttccgaccgggtaacccggcggttaccccgttccccgtaaccgttccgggtacttacccgtttccccgtaaccggttttccccccgaagtttaccccgg

SEQ ID NO: 274982 - DNA, 704 bp, Homo sapiens
  misc_feature: GYAE6OF02GAO7M.27.23.C01.1.454.CMB.1.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (329)..(329): a, c, t, g, unknown or other
  misc_feature (329)..(329): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctctcactcagggcacagggtcctgggcccagtctgccctgactcagcctgcctccgtgtctgggtctccgtggaccagtcgatcacctatcctcctgcacgtcggaacccngatgacgttggtntcttataactttntcgttggttcggtaccgtacgacggaccctaggcctacgtcgtaacccgaactctactttactttangtactcgtacaacgttaaccgtcccgggtccccgttaggggtttctagtacgttccgtcgttctacgtcggtacctaccgtaagtcgtacgtacctacgaccggtcccttaccgtacgacctacgtccgtccgggtctccacgtccgtagcgggtacgcggtcttaggtactttagtcgtttaggtacgttactaacgtaactaaccgaacgttaggtacgacgttaacggtttgggtaacggtccgggacgggaacggtccgaggttccgtacggtaccgttccgtacgtccgtaacggtacccgtaacggtcccgtcccggtacccgttcggttacccgtacgttccccgtaccgttacccctacccgtaccg

SEQ ID NO: 274983 - DNA, 702 bp, Homo sapiens
  misc_feature: GYAE6OF02HDGOK.27.23.C01.1.454.CMB.1.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgccctcgtgtctgggtctccgtggacagtcgatccactatcctcctgcactcggaacccgngatggacgttggngtacttattaacttntgttagttcggtaccgacgacggacccaggcctacgtcgtacccctaaacgtctatttcttatgtagttcgtactaagttaccgtcccggtccccgttaaggggtttcctagtacgttcgtcttcgtagtcggtacctaccgtaagttcctacgtacctaacgacccggtccctcccgtacgtaccgtcgtccgtccggtactccgacgtccgtaggacggacgtcgttacgtgttaacttagttagttagttacgttactaactacgtaacctaaccgagtacgaccgttacggtggttacgggtcggacgggtaaggacccgtaggccttacgggtacccgtccgtacggaccggtaccgtaacccggtacgtcccgtccgtacccccggtagttacccgtaccgttccggttccccttacccgtacccttaccgg

SEQ ID NO: 274984 - DNA, 611 bp, Homo sapiens
  misc_feature: GYAE6OF02IRGSB.27.23.C01.1.454.CMB.1.raw
  modified_base (230)..(230): a, c, t, g, unknown or other
  misc_feature (230)..(230): n is a, c, g, or t
  modified_base (349)..(349): a, c, t, g, unknown or other
  misc_feature (349)..(349): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaacccngatgacgttggtgcttataactttatcttgttggtaccgacaggacccaggcactcgtcccccaaactctattctttatgatgtcagtaactccggcccctaggggtttctgtatcgtnttctatggctccaagtctgacctacgacggtcctccctgaccactaccgtccggactccgacgtcgtacgacggacgagctgtaatttattagtttagtacttactatactacaaccgagtacgacgtcgttcgggtacggtttcggacgggacggaccgtaggccgttacgacccgttcgtacgtccgaacggtcccaagggtcctacccgtcccccgttacgggtccaccgttaccgttcccgttacccaccccttcccg

SEQ ID NO: 274985 - DNA, 687 bp, Homo sapiens
  misc_feature: GYAE6OF02FU29D.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgngatcgacgttggtgtcttaattaactttatcttggttcggtaccgacgtacggacccaggcactcgtaccccaaacttctactttctttagtgtattcgtactaacggtaacgtcccgggacccccggtaggggtttctgtacgtccgtccttctagtcggctccgtaagtcgtcgcctacgccggtccctcctcgacctacgtccgtcccggtcctccgacggtcctaggacgggacggaggtacttagtatttacgttagtttacgttagttactaagttaactaaccgtaccgtagttacgtacgttacggttagggttcggtaccgggtacggggtacggtacggacggtacgtcgtacccgtacgtacggtccggacgacccggaacggtccttacccggtccccgtcggtacctccgttcccgttcccgttaccccctacccgtacccg

SEQ ID NO: 274986 - DNA, 833 bp, Homo sapiens
  misc_feature: GYAE6OF02IA38P.27.23.C01.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctcgcctgactcagcctgcctcgtgtctgggtcctcctggacngtcgactcaccatccgtcctcgacacgtcggaacccgngatgacggttgtgtaccttattaacctttntctggttacggaccgacgtacggcccaggtaccactccgttaacccccaaactcgttaattttacggtttaacgtacgtacgttcgtaccctaaagtttaacggtccccgggtacccccggttaagggggttttcctacggtaacggtcggttcctttaccgtacggttcggtctaacccttaaagggtccttacggcccttaaaaaccgccgggtacccctttacccgtacgtaaacccgtacgttttcccgtaacccggggttccctttaccggaaccggttcccgttacggaaccggggtaacgggtaacgggtcgtacgttaacttttaacgttttagtaaccggtttcttaaccgtaacgttaccgttaacctaaaccggtaggttacctaacggttaccgggttttaaggtccgggtttccgggaccggggtaacggtcccgtaaaggtcctacgggttacccgtaaccgtacggttacgaacccggtaacccgtaaggcccgttcccgtacccgttccggtactacccgttcccggtacgtttacccccgtccttacccg

SEQ ID NO: 274987 - DNA, 915 bp, Homo sapiens
  misc_feature: GYAE6OF02GX908.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcaggcacagggtcctgggcccagtctgccctgactcagcctgcctccgtgtctgggtcctccgtggacagtcgatcaccatcctcctgccacgtcggaaccccgcgtaagtcggtacggttggtcgtactttaattaactttatcgttggttacggtaccgacaggacccaggacaccgtccgtacccctaaactctattctttatgtatgactagtaactcccggtccccggtagggtttctagtacgttccgtcttctacgtcggccttaaccgtaacgttccttacccgtaaccggtacccggttcccttaccccgccggtaaccctaccgttcccggtttaccccggggtccctacccgggtaaccggtcccggtacggggtaacgggtaaccgggtaacggttaccgttagttaaacggttttaacgttttaagtttccggttttaaacggttaacttaaacgtttaaacctaaccggtaaacccgttaagggtaccggttaaaccgttacggggttttaccgggggttacgggtttaaccggggacccgggggtaacggggtaaccggtaacggggttacccttaaccggggttacccccggttaacccggttacgggttacccccgtaacgggtaacccccgggttaacgggtaacccccgggtttcccccggaacccccccgggttttaaccgggtcccccgttaacccggttttcccccgtttcccccccggggttttcccccttacccccccggtttaccctaacccccgggg

SEQ ID NO: 274988 - DNA, 752 bp, Homo sapiens
  misc_feature: GYAE6OF02JFIJX.27.23.C01.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
tcagagcgtcgtctcacgaccggtgctcgatttagtacacgtgattagggattgggggggggtctcagggaggcagcgctctcgggacgtctccaccatggcctgggctctgctattcctcaccctcctcactcagggcacagggtcctgggcccagtctgccctgactcagcctgcctcgtgtctgggtctcgtggacngtcgatcaccntctctgcactcggaacccgngtatgacggttggtgtacttaattaacctttatcttaggtttcggtaccgacgacgggacccaggccatccgtaaccccaaatctatttcttatgtattcgtacaacgtacgtcccggtacccgtaggggttcctaggtacttcggctttactacggtcgtacccgtaccttaacggtcctaccggtaccctaaccggtaccggtccctacccgtacgaaccctacgttcccgggttaccgtcctaccgtacccgtaccggtagggtacgggtaccgacggttcgttaaggttactttacgtttaggttcgttaacgttactaaacgtttacaacccgtaacgtacggttactaaccggttacgggtttacggggttacgggttccgggacggtacggggtacgtacggtccttcgggtacccttacggacgggttaccgacccggtacgacggtacccgttcccggtacccgttccgtaccgtaccgttcccgttacccggttccccgtaccccctcggg

SEQ ID NO: 274989 - DNA, 783 bp, Homo sapiens
  misc_feature: GYAE6OF02GIHFY.27.23.C01.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccncgatgacgttggngtcttataactttatctgttggtaccgacacggacccaggcactcgtaccccaaactctattcttatgatgtcagtaacgtccggccccgtagggtttctgactcgtcttctagtcggctacaagtctcgacctacgaccggtccctcccgtagtaccctacgttcccgtaccgggtcctacccgtacggtcccgttacgggacgggaaccggtacgggtcgttacggttaacttttaacgtttaagtttacggtttaacgttttacctaaacgttaaaccttaaacccgaaaccgttaagggtttaaccgtaaccggttaacggttttacggggggtttaccgggtttaccgggggtaccgggggtaacggggtaacccggacgggtaccgttaccgggtacccggttacccggttacgggtacccgaacgggtacccccgtaaacggggtcccgttaccccggttaccccccggttacgggttaccctaacccggtttcccgtttaccccggtttaccccccgtaccccgttacccccg

SEQ ID NO: 274990 - DNA, 708 bp, Homo sapiens
  misc_feature: GYAE6OF02ILE96.27.23.C01.1.454.CMB.1.raw
  modified_base (235)..(235): a, c, t, g, unknown or other
  misc_feature (235)..(235): n is a, c, g, or t
  modified_base (463)..(463): a, c, t, g, unknown or other
  misc_feature (463)..(463): n is a, c, g, or t
  modified_base (479)..(479): a, c, t, g, unknown or other
  misc_feature (479)..(479): n is a, c, g, or t
tcagagcgtcgtctcacgaccggtgctcgatttagtacacgtgattagggattgggggggggtctcaggaggcagcgctctcgggacgtctccaccatggcctgggctctgctattcctcacccctcctcactcagggcacgagggccctgggcccagtctgccctgacctcagcctgcctccgtgtctgggtctcctggacagtcgatcaccatctcctgcacgtcggacccgngatggtacgttggtcgtacttattaactttatcgttggttcggtaccgacacggacccaggccactaccgtaccctaactctatttctttatgtagttcgtactacgtaacgtcccggtaccccgttaggggtttctagtactccgttacttcgtagtcggtacctaccgtaagtccgtcgtacctacgacccgtccctccctacgacctcgtccgtccggctaccgngtccgtgaacggacgngtcttagtaactttagtttgttacgttacgtttacaacttaactaccgaacgtagtacgtacgttacggtttgggtacggttccgggacgggtacggaaccgtcggtaaccgttccgtaacccgttccgtacggtacccgaaccggtacccgtacggtcccgtaccccgtacccggttccggtaccgttcccgttcccgtttaccccggtaccccctacccgttacccg

SEQ ID NO: 274991 - DNA, 760 bp, Homo sapiens
  misc_feature: GYAE6OF02JE32M.27.23.C01.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (320)..(320): a, c, t, g, unknown or other
  misc_feature (320)..(320): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcacgggtcagggcacgagggtcctgggcccagtctgccctgactcagcctgcctcgtgtcgtgggtctcgtggacngtcgatcaccatctcctgcacgtcggaacccgngatgtacgttggtntacttaattaactttatcttggttcggtaccgacgacggaccnggcactcgaccccaatctatttcttangtatgtactacgtacgtcccggtcccggtagggtttctagtactccgttcttagtacgttcggtacctaccgtaacgtccgtacgtacccgtaccgtcccggtccccttacccggtaccgtaaccctaccgttcccgggtcccggtacccgtacccgtacggtcccggttaagggaccgggtaacggtacggtacgttaggttaactttacgtttagtttacgttagttactaacgttaacctaacgtaaccgtaggtacgtaacgttacgggtttacgggttcgggttaccgggaccggggtacgggtaccggtacggtaccgtaccggttacccggtacgttaccggtaccgtaaccggacccgtacggtcccgttaccccgtcccgttaccggttaccgtccgttacccgttcccggttaccccctccgtaacccgg

SEQ ID NO: 274992 - DNA, 581 bp, Homo sapiens
  misc_feature: GYAE6OF02FTMHA.27.23.C01.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (483)..(483): a, c, t, g, unknown or other
  misc_feature (483)..(483): n is a, c, g, or t
tcagagcgtcgtctcacgaccggtgctcgatttagtacacgtgattagggattggggggggtctcaggaggcagcgctctcgggacgtctccaccatgacctgggctctgctattcctcaccctcctcactcagggcacagggtcctgggcccagtctgccctgactcagcctgcctccgtgtctgggtctctggacngtcgatcaccatctcctgcactcggaacccgngatgacgttggtgctttataactttatcttgttcggtacgaccccaggacccaggccactcgtccccaaactcatttcttatgntgtcagtaactccggcccctagggtttctgactcgcttcagtggctcaagtctgtccacacggcctccncaccatccgcggctcacgccgtgaggacgngctagtagttattagttgtacgttctaagtactaaccgactagtntactacgttgggtagtcggacgggngaccgagtctacgaccgttcgaggccgtacgtacccggaaggtcctcccggtcccgtacggttccacgttcccgtccgttaccccgacccgttacccg

SEQ ID NO: 274993 - DNA, 668 bp, Homo sapiens
  misc_feature: GYAE6OF02JYA2O.27.23.C01.1.454.CMB.1.raw
  modified_base (236)..(236): a, c, t, g, unknown or other
  misc_feature (236)..(236): n is a, c, g, or t
  modified_base (501)..(501): a, c, t, g, unknown or other
  misc_feature (501)..(501): n is a, c, g, or t
tcagagcgtcgtctcacgaccggtgctcgatttagtacacgtgattagggattgggggggtctcaggagtcagcgctctcgggacgtctccaccatggcctgggctctgctattcctcaccctcctcactcagggcacgagggtcctgggcccagtctgccctgactcagcctgccttccgtgtctgggtcctcgtggacagtcgatcaccatctcctgcaccgtcggaaccccgngagtgtacggtttggtacgtctttaattaactttattccttaggttacggtaccgacgaacggaccaaggccacgtccgtaccccaaactctaactttcttagtcgtatgtactacgttaacgtcccggaccccgttgggtttcacgtctccgttcttctcgtcgtcctacgactctcacctagccgtccctcgtacactcgtcctccggtctccgacgtcgtagaacgggtcgagtctattacgttagtttacgtggttacttntaacgttacctaacgaccttagtacggtacttccgggttttaggtacgggttcgggaccggtacggtaccgtacgggtccgtaccgtaccggttcgtaacgaccgtaccgaccggtagtcctccgtccccgtacgtcctcgttcctcccgttaccccgcttacccgg

SEQ ID NO: 274994 - DNA, 762 bp, Homo sapiens
  misc_feature: GYAE6OF02JN5EG.27.23.C01.1.454.CMB.1.raw
tcagagcgtcgtctcacgaccggtgctcgatttagtacacgtgattagggattggggggggtcgtcgaggaggcagcgctctcgggacgtctccaccatggcctgggctctgctattcctcaccctcctcactcagggcacgagggtcctgggcccagtctcgccctgactcagcctgcctcgtgtcgtggtctcctggacagtcgatcactactctcctgaccactcgggaaccccgcgagttagacggtttggtcgtacctttaattaaaccttttattccgttgttcggttaccgacgtaacggaccgacggccgactccgtaccctaactacctactttctttaatgtatgtcagtaactccggtcccgtacgggtttccgtagtaccttcgtaccttctatcggtactccgtaagttctcgtaccgttcaccggtcccgtacccttccggacctacgtccgtccggtcctaccgtacgtacccgtacggaacggtacgggtacggaccgttcgtaagtttatttagttcgttaacgtttactaacttaacgaacctaaccgtaagttacgtaccgttaacggtttcggggttcggttaccggggtaacggggtacggtaaccggtaccggtagtaccgggtacccgttaccgggttaccgccggaacccgttacccggtaacggcccgttccccggttccccgtacccgggttccgttaccttaccggtttaccccgttcccgtaccccgttacccg

SEQ ID NO: 274995 - DNA, 607 bp, Homo sapiens
  misc_feature: GYAE6OF02GAE8G.27.23.C01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaaccccgngatggacgttggtgcttaataactttatctgttggtacgacaggaccaggcactcgtaccccaactcattctttatgatgtcagtaatccggcccctagggtttctgtatcgtcttctatcggctccaagtctcgctacgacggcctccgtacgacctatccgtccgggctccgacgccgtggacggacggagctgtattacgttagttgttagttctaatactacaacctagtcgaacctacggtttgggttcgggttcgggaccgggaacggggaccgagggtcctcggtacccgttccgtaaggtccgtacgacccgaacgggcctaccgccccgtcggtccaccgttctccggttcccgccccttacccg

SEQ ID NO: 274996 - DNA, 863 bp, Homo sapiens
  misc_feature: GYAE6OF02G1D1C.27.23.C01.1.454.CMB.1.raw
tcagagcgtcgtctcacgaccggtgctcgatttagtacacgtgattagggagttgggggggggtctcaggaggcagcgctctcgggacgtctccaccatggcctgggctctgctattcctcaccctcctcactcgagggcacgagggtcctgggcccagtctcgccctgactcagcctgcctccgtgtcgtgggtctcctggacagtcgatcaccatcctcctgaccacgtaccgggaacccgcgtagtcggtacgtttgggtctacttaacttaactttattcgttggttacggaaccggtacgaacggacccgaggacctacgtacccgtaacccctaaacttctacttttacgtttagtacgtagttacgtaacgtaagttaaccgtcccgggtaccccggtttagggttttcacgtacttccgtcttacgtacgtcggtacctacgtaacgttcgtaccgtacgtaccgtacccggtccctttaccgacgtaaccgttccgtcccggtacccggtcctacccgtacgggtacccggtaggggtaaccggaacggtacggttcttaggttaaactttacgtttaacggttcgttaacgtttaacgtaaacgttaaccgtaaacccgtaacggttacggttaaccgtaacgggttttaaccgggttttggggttaacccgggttccggggaaacggggtaccggggtaaccgtacgggtacccgggttacgtaaccccggttaggtacccggttaaccggaaccgggtaaacccgtccgggttccccggtacccccgttaccgggtcccggttacccttaccgggttcccgtttaccccggtaccccccttactacccggg

SEQ ID NO: 274997 - DNA, 673 bp, Homo sapiens
  misc_feature: GYAE6OF02H7UD2.27.23.C01.1.454.CMB.1.raw
  modified_base (232)..(232): a, c, t, g, unknown or other
  misc_feature (232)..(232): n is a, c, g, or t
  modified_base (369)..(369): a, c, t, g, unknown or other
  misc_feature (369)..(369): n is a, c, g, or t
  modified_base (508)..(508): a, c, t, g, unknown or other
  misc_feature (508)..(508): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtcggaacccgngatggacgttggtgtcttaataacttttatcttggttcggtaaccgacgacggacccgaggcctacgtacgtaccccaaactctaactttcctttatgtattgtactagttaactcccggtccccgtaggggtttcngtactccgtcttcgtagtcgtcctacagtcgtcgacctacgaccgtcccttcccgtacacctacgtccgtacccggtctcccgacgtccgtagggacggtacggacgtctagttactttatttagtttagttacgttanaataactaaccaacgtagtacgtaaccgttggttcgggttaggttccgggacgggtaacggccgagggtccgtcggacccgttacgtcggtaccgcggtacccgtacggtcctcccgaccccgttcggtcctaccgttcccgttcccgttcccccaccttacccg

SEQ ID NO: 274998 - DNA, 990 bp, Homo sapiens
  misc_feature: GYAE6OF02HO0Q5.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacagtcgatcaccatctcctgcctacgtcggaacccgngagtcgacggttggtcgtactttaataactttgtcgttaggttcggtaaccgacgtaacggaccccaggtaccacgttccgtaaccccctaaacgttcctaacgttttccttaagtgtacgttcggtacgtaacggttaacgtccccgggtacccccggtttaggggttttctacggtacgtttaccgtacgttttaccgtacgtaccggtacccgttaaccgtaaacggttcctaccggtaccccgtaaaaccggtaccccgggttccccttaccccggtaaccgtaacccgtaaccgtttacccgggttcccccgggtacccttacccgaaccggttacccggttaacgggggtaaaccggggtacccgggtaacggttaccggtttaagggtttaactttttaaacgggttttaacggtttacggttaaaccgtttttaaccgaaacgtttttaaacccgaaaacccgttaaccgtaaacgggtttccgtaaaccggttttaccggggttttacggggggtaaccgtttccggggggaaaccggggtaaccggggtaacccgttaacgggttccgggttaacccggttacccggttaaccgggtttaccgggtaaacccgggtacccggttaaacccccgggtaaagggttcccccggttaacccccgggttcccccgggtttaccggtaaccccgttaaccggtttcccccgttttaaaccccggtccccccgttacccccgttaacccggg

SEQ ID NO: 274999 - DNA, 780 bp, Homo sapiens
  misc_feature: GYAE6OF02HZQDG.27.23.C01.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
tcagagcgtcgtctcacgaccggtgctcgatttagtacacgtgattagggattgggggggggtctcaggaggcagcgctctcgggacgtctccaccagtggcctgggctctgctattcctcaccctcctcactcgagggcacgagggtcctgggcccagtctgccctgactcagcctgccctcgtgtcgtgggtctccgtggacagtcgatcaccatcctcngccacgtcggaacccgngtagtgtacgttggtctactttaagttaacttttatcgttaggttcggtaaccgaacgtacggaacccaggcctacgtaccgtacccctaaacttcttacttttcgttatggtaattcggtactaacgttaaccgtccccgggtaccccggtttagggttttcacgtacgttcgtcttacgtacgtcggtaccttaccgtagtccgttaccgtacccgttacgtacccggtcccttcccgtacgtaaccctcgtccggtcccggtaccctccgacgtcgtagggaccgggtacgcgtacgtaagttacgtttatttagttacgttacgttacgtaattaacgtaactaacgtggttacgtaaccgttggtttcgggttacgggtacggggtacggtagggtccgtaaggtaccgtcgggttacccgttccggttaaccggtccggaacccggtacccggtaacggtccctaccccggtacccccggttggtacccccttaaccgttcccgtttaccccttcccccgtaccccgttacccgg

SEQ ID NO: 275000 - DNA, 924 bp, Homo sapiens
  misc_feature: GYAE6OF02H7K9L.27.23.C01.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (399)..(399): a, c, t, g, unknown or other
  misc_feature (399)..(399): n is a, c, g, or t
tcagagcgtcgtctcacgaccggtgctcgatttagtacacgtgattagggagttgggggggggtctcaggaggcagccgctctcgggacgtctccaccatggcctgggctctgctattcctcaccctcctcactcaggcacgagggtcctcgggcccaggtctcgtcccgtgacctcacgcctcgcctccgtgtctgggtctcctggacngtcgatcacctatctctagctacgtacggaaccccgngtactacggtaccggttggtacgttacttttaacttaaccgttttatcgtttagggttaccggtaacccggtaacaaccggtaacccccgaggaccccgtacggttaccctaaccccctaaaacttacgtttacttttaccgtttttaaagnggtttaccgtcgttaacgtaacgggttaaaccggtccccccgggtcccccgggttttaaagggtttcccggagtttaccgtccgttcctttaacgtaccggttacgtcccccggttaaactacggttccgaccgttaaccccgtacggtaccccgttcccggtaaccctaccggacccttttactccccggttacccggtacccgtaccgtaccgggtccgtacgggtaacggtaccgggtaacggtcgttaagttacgtttacgttttacgttacgtttaccggttaactacgttaaacgtacctaacgtacggttacgtaccgttaacgggttcggtttccggggtaaccggggcggtaaccgggttaccggtacggtcccgtttaacgggtacccgtacggttcccgggtaaccgcggtaaaaccccgtccgggttaaccctcccccgttaccccggttaccccggttctaccccggtttcccggtttacccccgttaccccccgttacggttaccccccgg

SEQ ID NO: 275001 - DNA, 612 bp, Homo sapiens
  misc_feature: GYAE6OF02JSGXD.27.23.C01.1.454.CMB.1.raw
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagagcgtcgtctcacgaccggtgctcgatttagtacacgtgattagggattggggggggtcgtcaggaggcagcgctctcgggacgtctccaccatgcctgggctctgctattcctcaccctcctcactcaggcacagggtcctgggcccagtctgccctgactcacgcctgccctccgtgtcgtgggtcctcctggacagtcgatcaccatctcngcncacggaccngatgacgttgngtacttatactttatctgtcggtaccgacgacggaccaggactctcgtaccccaactactacttctttatgagttcgtacgtacgttaaaccgtccgggacccccgttaagggttcctgtaacgtccgtacttcttagcgttctaaccggtactcgtacgtcgtaaccgccgtcccgtcccttacgacctacgttccgccggtactccgacgccgtaggacgcgacgtcgtagttatattcgtagttactntactactanacgntagacgtgtaggtnacggnggacgtacgagtccgagtacgtcgtacgcgtaccgacgacgtcgtccccgccgttccgtctaccgtccgtaccctacccgtccctccg

SEQ ID NO: 275002 - DNA, 813 bp, Homo sapiens
  misc_feature: GYAE6OF02HV8FH.27.23.C01.1.454.CMB.1.raw
  modified_base (203)..(203): a, c, t, g, unknown or other
  misc_feature (203)..(203): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacngtcgatcacattctcctagctacgtacggaacccgcgattcggacgtttggcgtactttaattaaccttttatcttaggttacggtaccgaacgacggtaaccaggctacctacgtaccccaaacttctaactttctttaatggtactagtactaacggttaacgtcccggtccccggttaaggggtttcctacggtaacttccggttacgttttacctaacggttccggtaccttacccgtaaagtttcccgtaccgtaaccccttaaccggacccggttcccccttaccccgtacgtaaccctacgttcccggtacccgggtacctaccgtaccgtaccgtacgggaacgggtaacggtacggtacgtaagtactttaagtttagttacgttagtttactaacgtaacgtaactaaaccgtagtaacgtccgttaacggtttgggttaccggttacgggtacgggaacgggtaccggtacggtccggtacggtaacccgttccgtaaccggtaccgaaccgtacccggtaacggtacccgtccggtacccccgttaccggttaccctacccgttcccggtttacccggttccccgtaccccgttcccg

SEQ ID NO: 275003 - DNA, 827 bp, Homo sapiens
  misc_feature: GYAE6OF02H7QT2.27.23.C01.1.454.CMB.1.raw
  modified_base (234)..(234): a, c, t, g, unknown or other
  misc_feature (234)..(234): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcaccatcctcctgcactcggaaccccgngattcgacgttggtacgtactttaattaacttttatcgttaggtttacggttaaccgaacgacgggaaccccgaagggcctaaccgttccggtaacccccctaaaacttaccttaattttacccgttttaagttagtacttagtacgtaaggtttaaaccgtcccgggtacccccgttaagggggttttccacggtactacgttcgttctaacgtcggtaccctacgtaacgtctaccggtaccctacgacccggtcccttccgacgtaccgtacgtccgtacccgggtcttccgacggtaccgtagggaacgacggtacggtacgtagttactttaagttttacgtttaggttaagtttacaaacgttaactaaccaaccgttaagtcggaaacctttacgggtttggggtttaaccggttacggggtaacggggtaaccgggtacctacggggttacctaccgggttaccgttaccggttacgggtaacccgtacggaaccccggttaacgggccttacccccggtcccccggttacggtaccccgtacgtttccccggttcccggtttaccccccgtcccgttaccccgg

SEQ ID NO: 275004 - DNA, 765 bp, Homo sapiens
  misc_feature: GYAE6OF02IMYNU.27.23.C01.1.454.CMB.1.raw
  modified_base (209)..(209): a, c, t, g, unknown or other
  misc_feature (209)..(209): n is a, c, g, or t
tcagagcgtcgtctcacgaccggtgctcgatttagtacacgtgattagggattgggggggggtctcaggaggcagcgctcgtcgggacgtctccaccatggcctgggctctgctattcctcaccctcctcactcagggcacgagggtccgtgggcccagtctcgccctgactcacgcctcgcctcgtgtcgtcgggtcctccgtggacngtcgactccacctactcctcctgccacgtaccgggaacccgagtacgtacggtacggttggtacgtactttaacgttaactttacgtcgttggtaccggtaccgacgaccggaccgagtacctacctccgtaacccctaattcttattttacgttaagtgtacgtacgtacgtaacgtccggtaccccgggtccggtttaggttcagttactccgttagttactacggtccgtacctacgtacgtccgtacctaccgtaccgtcccgtacctacgacctaccgtcgttcccgaccgtccgtcgaccgtagggacgcggtaacgtcttagtattaactttattacgtacggttaacttactaacccttaaacgtaccgttacggacggtttaacgtcgggtttaccgggttagggtaccgggtacgggaaccggtacgtaccggtcgttaccggtaccggtacgttacgaccgttaccggccgttaaccgccgttccccgacccggttaccgttactacccggttccttcccggtacccgtacccctcgtaacccgg

SEQ ID NO: 275005 - DNA, 818 bp, Homo sapiens
  misc_feature: GYAE6OF02JW28D.27.23.C01.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcaggcatagggtcctgggcccagtctgccctgactcagcctgcctccgtgtcgtggtctccgtggacngtcgatccacatctctgcacgtcggacccgngtatcgtacgttggtntacgttaactaactttgtcgttcggtacggtaaccgacgtaccggtccagtaccgtactaccgtaacccctaaatccttacgtttacgttagtacgtacgttcgtaacgtaacgttaccgtccggtaccccggttagggtttctagtaacgttcgttacgttacgtacgtccgtaccttaaccggtacgttccgttaccgtacccgtaacccgtaccggttccctcccggttacgtaccgtaccgttcccgggtccgggtacctaccggtaccgtacggtacggtaacggacggtaccgttacgttacgtttaacgtttacgtttacgttacggtttacgttaactacgttaaacctaacgtaaaccgtaaccggtacgttaacggttacgggttacgggtttacgggtaccggggtacgggttaaccgggtaaccggttcggaacccgggtttctacccgggttacgtaacggtacccggaccgttaaccgtacccgggttaaccgtccccggttaccccgttacggtcgttacccgtttcggaccccggtttcccgtcccgtaacccgg

SEQ ID NO: 275006 - DNA, 700 bp, Homo sapiens
  misc_feature: GYAE6OF02JAGWC.27.23.C01.1.454.CMB.1.raw
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgngtcgtggtctcctggacagtcgatcaccatcctcctgcactggacccgngatgacgttggtnacttataacttntctgttggaccgacacggacccaggctacgtcgtaccccaaactctactttctttatgtatgtagtaacgtaacgtccggccccgtagggttttctagtactcgtcttctagtcggtccttactaggtcctacgtaccctaccgacgtccctccctacggaccctacgttcccggtaccgggtcctcgaaccggtccgtaggaacgggtacggacggtcttaggtaattttacgttagtttacgttacgtttcgtaatttaacgaacctaaccgtgtacggtaacctttacggttaggggttacggttccgggtacgggacgggttaaccgtacggcgttacggtaccggttcctaagggtaccgcggtaacccgtaggccgttcccggtaccccgttaccggtaccctaccgttcccgtaccgtttacccccgacccttacccg

SEQ ID NO: 275007 - DNA, 717 bp, Homo sapiens
  misc_feature: GYAE6OF02F3E0W.27.23.C01.1.454.CMB.1.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
  modified_base (398)..(398): a, c, t, g, unknown or other
  misc_feature (398)..(398): n is a, c, g, or t
  modified_base (443)..(443): a, c, t, g, unknown or other
  misc_feature (443)..(443): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgactcagcctgcctccgtgtcgtcggtccggggtcctggaccagtcgatccaacntcctcctgaccacgtggaaccccgngatagcgttggcgtacctttaattactttatcttggttacgtaaccacgacggcccaggccactccggtaaccccaaactctaactttcgttaagtagtattcgtactaagtacggtccccgggacccttagggtttcagtcgtcgtacttntctggacctacgagttcctcgacccgtacgccgtaccttcccgtnaacccgtgttcccgtccgggccctacgacggtcccgttaagggaccgggtacgtacggtccgtaacgttaagttacgtttacgttacgttttacggtaacttaggttaaacctaacgtaaccggttacgacgtaacgttacgggttcggttcgggtaccggggacgtaaggggtaccctaggtccgttacgtacccgtacgttaacgcgtaaccgacccggttagcccgttaccgtcccgcgtccgtacctccggtcccttcccgaccgtccgg

SEQ ID NO: 275008 - DNA, 803 bp, Homo sapiens
  misc_feature: GYAE6OF02GYRDM.27.23.C01.1.454.CMB.1.raw
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (272)..(272): a, c, t, g, unknown or other
  misc_feature (272)..(272): n is a, c, g, or t
tcagagcgtcgtctcacgaccggtgctcgatttagtacacgtgattagggagttgggggggggtctcaggaggcagcgctctcgggacgtctccaccatggcctggctctgctattcctcaccctctcactcagggcacgaggtcctcgggccagtctcgccctgactcacgcctgcctccgtgtcgtcggtctccgtgacagtcgatcacctntctcctgccacgtcggaacccngtagtcgtacggttggtcttacttaacttaactttntcgtttacggtttaccggaaccgaacgtaccggaaccgtacggacctacccggttaccgtaacccctaaattaccttatttacttacgcgtagttcgtacgtaacggtaccgttccccgggtaccccgggtttagggttccttagaccgttccgttcctttagtacgttcggtaccctaacgttagtccgttcgacccttaaccggaccgttccctaccggtcaacctcccgttccgacccgggtactccggacgtacggtacggacgggaccggtaggtacttaggttaacttttatttaacgttacggttacgttaactaaacgttaccgtaacgtaacgttacgtacgtacgtacgggtttggggtaccggtcgggaacgggtaacgtaccgggacgttacgtaacccgggttaccgttaaccggtcgtaccgtaacccgggtaccgggtaaccgtcccggttaacccccgtccggttaacccggtccttacccgttccgtcccccgtttcccgacccgtttaacccg

SEQ ID NO: 275009 - DNA, 774 bp, Homo sapiens
  misc_feature: GYAE6OF02FZNCE.27.23.C01.1.454.CMB.1.raw
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgactccaccatctcctgcacgtacggacccncgtatgtacgttggtntcttaattacttatcgttggttcggtaccgacgacggtaccgaggcctacgtccgtaccccaacttctactttcttatcgtatcgtacgacgtacgtccggacccgtagggttctcggtactccgttcttcgtacgtcgtccgtacgtacgtcgttacggtaccctaccgtaccggtcccctaccgttacgtaccccttacgtcccggttcccggtcctaccccgtaacggtcccgtaagggtaaccgggaacgggtcgtaccgtttagttaacgttttaagtttagttttacggttagttacttaacttaacgtaaccgtaacgtcgtagtaaccgtcgggtttcgggttaccgggttacggggcgggtaaaccgggtaccgtagggtacccttacccgggtaccgtttacccgtacggttaccggacccgaaacccggtacggttccccgttcccggtaccccgttaaccgggttctaccccggttcccgtttaccccggttcccccgtacccttaccccgg

SEQ ID NO: 275010 - DNA, 760 bp, Homo sapiens
  misc_feature: GYAE6OF02H0HAX.27.23.C01.1.454.CMB.1.raw
  modified_base (227)..(227): a, c, t, g, unknown or other
  misc_feature (227)..(227): n is a, c, g, or t
  modified_base (337)..(337): a, c, t, g, unknown or other
  misc_feature (337)..(337): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcaggcacagggtcctgggcccagtctgccctgactcagcctgcctcgtgtctggtctctggacagtcgatcaccatctcctgcactcggaacccgngatcggacgtttggtgtactttaattaacttttagtcttaggttcggttaacccgacgacgggtacccaggaccaccgttcgtacccccaaacttctaactttactttanacgtatcgtctaaggttactcccggtaccccgttagggttttctacgtacttcgctttacgtgtacggtcctacctaagttctacgtaccctaacgacccggtcccttccctacgtaccctaagtcccggtacccgggtccttaccgaccggttccgtaggggaacgggcggtacgggtcttaagggttaactttacgttttaacgtttagtacgtttacttaacgttaacctaactaacgtaacgttcgtaacggttcggtttaggggtttaccgtccggggacgggtaccggaaccgtggaccttacgggttaacccgttccggtaggtacccgaacggtaccccgtaggtaccccgtcccgtccccggtacggtccctaccgtttcccggttaccccgttcccccggtccttaaccccgg

SEQ ID NO: 275011 - DNA, 792 bp, Homo sapiens
  misc_feature: GYAE6OF02HQZFY.27.23.C01.1.454.CMB.1.raw
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
tcagagcgtcgtctcacgaccggtgctcgatttagtacacgtgattagggattgggggggggtctcaggaggcagcgctctcgggacgtctccaccatggcctgggctctgctattcctccaccctcctcactcaggcacagggtcctgggcccagtctgccctgactcagcctgcctccgtgtctgggtcctccgtggacagtcgatcaccatctcctgccacgtcggaaccccgngatgtacggttggtgactttataaacttttntcgttggttcggtaccgacacggacccaggcactcgtaccccaaatctactttcttatgtattcgtacgtaacgttaaccgtccccgggtaccccgtttaggggttttctagtacgtccgttctttacttagtcggaccttcgtaacgttctacgaccctaacgacccggtccctacccgtcaccgttactccggtcccggtcctaccgtacggtcccgtagggaacgggacggtacggtccttaaggttacttttaacgtttacgtttgggtttaactttcgtaaattacctaaccgaaaccgttggttacgtaacctttcgggtttacggggttacgggttccggggacggggttaacccgggtaccgtaacggggtccttaacccggggtcccgttaccgtaacggggttacccgaaccggtacccggtaacgggtccccgttaccccgtccccccggttaccgggttaccctacccggtttcccgtttacccccgtttaccccctaccccgtttacccgg

SEQ ID NO: 275012 - DNA, 640 bp, Homo sapiens
  misc_feature: GYAE6OF02HIGEL.27.23.C01.1.454.CMB.1.raw
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
tcagagcgtcgtctcacgaccggtgctcgatttagtacacgtgattagggattggggggggtctcaggagcagcgctctcgggacgtctccgaccatggcctgggctctgctattcctcaccctctcactcaggcacagggtcctgggccagttctgccctgactcagcctgcctcgtgtctagggtctccgtggacagtcgactcacctatcctctgcacgtcgggaaccccngaatcgagttggtctacttaataactttatcgttggtacgaccgacgacggaccngctactccgtacccaattctactttacgtatacgtacgtcgtactaagtaccgtaccggtacccgttaggttcagtcgtcgtctacgtgtcgtaccgtacgtacgtctacgtacctacggtaccgtcctaccgtacgtcctaccgtccgtccggtactaccgacgtccgtaggtacggacgtacgtacgttacgttaagtttacttacgtagttacttactaacgttacacgtactagtacgtacgttggttcggtacgtcggacgtacgactcgacgtacgaccgtgtacgtacgacgtaccgacgtcctccgtccctagtacctcgttcccgtaccgtcccgtctaccg

SEQ ID NO: 275013 - DNA, 695 bp, Homo sapiens
  misc_feature: GYAE6OF02HML6I.27.23.C01.1.454.CMB.1.raw
  modified_base (202)..(202): a, c, t, g, unknown or other
  misc_feature (202)..(202): n is a, c, g, or t
  modified_base (505)..(505): a, c, t, g, unknown or other
  misc_feature (505)..(505): n is a, c, g, or t
tcagagcgtcgtctcacgaccggtgctcgatttagtacacgtgattagggattggggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacngtcgatcaccatcctcctgcacgtcggaacccgcgatcggcggttggtcgtctttaattaacttttatcttggttaggtaccgacgacggaccgaggctacgtcgtacccctaaactctatttcttatgtacttcgtacgtacgttaaccgtcccggtacccccggttggggtttacctgtacttcgtcttacgtagtcggtcctacgtaagttctaccgaccttacgaccggtcccttcccgtacaccgtacgtccgtcccggtactcccgacgtccgtacgggaacgggtacggaccggtntacggttaacttttaagtttacgttacggtttagttactaagttaacctaaccgaaaccgtagttcgacgttacggtttgggtcgtcgggacgggtacgacgtaggcgtacgaccggtcgtacggctacggaccgtcgtccgtcccgtcccttcggtactccttaccggtcccttacccgtccctaccgg

SEQ ID NO: 275014 - DNA, 737 bp, Homo sapiens
  misc_feature: GYAE6OF02G8I4I.27.23.C01.1.454.CMB.1.raw
  modified_base (234)..(234): a, c, t, g, unknown or other
  misc_feature (234)..(234): n is a, c, g, or t
  modified_base (367)..(367): a, c, t, g, unknown or other
  misc_feature (367)..(367): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacgagggtcctgggcccagtctgccctgactcagcctgcctccgtgtctgggtctccgtggacagtcgatcaccatcctctgccacgtcggaacccgngatgacgtttggtctacttaattaacttttatcgttggttcggtaccgacgtacggacccaggcacgtcgtaccccaaactctatttctttatgtatgtacgtagtaacgtcccggaccccgttagggtttcngtctcgtcttcgtagtcggtcctaccgtagtccgtacgtaccctaacgtacccggtaccccttccccgtacgtaccctacgttcccggtcccgggtcctacccgtacgtcccgttagggaacgggtacggtacggtcttaagttactttagttacgtttaggttacgttactaagttaacctaaacgtaaccgtaggttaacgtaacgttaacgggtttcggggtacggtttccggggacgggtaccgggtaaccggacggtccgttaccggtccgttaccgtacggtaccgtacggacccgtaacgggtcccgtacccgtccccgttcggtccctaccgttccgtacccttccccggtacccttcccgg

SEQ ID NO: 275015 - DNA, 913 bp, Homo sapiens
  misc_feature: GYAE6OF02ICFAX.27.23.C01.1.454.CMB.1.raw
  modified_base (121)..(121): a, c, t, g, unknown or other
  misc_feature (121)..(121): n is a, c, g, or t
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
tcagagcgtcgtctcacgaccggtgctcgatttagtacacgtgattagggattcggggggggtctcaggaggcagcgctctcgggacgtctccacagtcggcctgggctctgctattcctnaccctctctactcaggcacgcggtcctgggcccaagtcctgcccctgacctcacgtcctgccgtccgtagtcttgggtcctccgtaggacctagtccgatcaacctntcgtcctagcctagtccggaaccctgaacttcggtcggttgtntacttaagttaaccttntcgttaggtcggtacctaagaccggtaaccgtacggactaccgtaccgtaacccctaactcttactttaccgttagacggttactggtaacgtaacggtttacccggtacccggtaccccggtttagggtttaccacgtaccggtttcgtaacgttcggtactccggtacctaccgtaagtccgtccgtaaccgtaccgtcccgtcccgtaccgtaccgtaccgtacccgtccgggtacccgtaccgtaccgtaaccggtccgtaaacggggtaccgggtaccgtcgggttaccgttaaggttaacttttaaccggtttacgttacgggtttaaccttaaccgttaacgttaacccgttaaacccgggtaaaccgtaaccgggtttacgtaacccgggtttaccgggggttttaacgggttacccggggttaacggggttacccgggtaaaacccggggttacacccgggtccggttaacccggtttacccggtaccggtaacccgggtccgtaaaaccccgggtcccgtaacgggttaccccccgtaacggttcccccgttagggttaccccgtttaaaccccgttccggggtaacccccttccccggtacccgttacccgggg

SEQ ID NO: 275016 - DNA, 781 bp, Homo sapiens
  misc_feature: GYAE6OF02HLTIS.27.23.C01.1.454.CMB.1.raw
  modified_base (239)..(239): a, c, t, g, unknown or other
  misc_feature (239)..(239): n is a, c, g, or t
  modified_base (274)..(274): a, c, t, g, unknown or other
  misc_feature (274)..(274): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcgagggcacagggtcctgggcccagtctcgccctgactcagcctgcctcgtgtcgtgggtctcctggacagtcgatcaccattcctctgaccacgtcggaaccccgngatcggtacgttggtcgtacttaacgttaactttntcgttggttacggtaccgaactacgggaccctaggacctacgtaccgtaacccctaagtcctatttacttatgtactgtactacgtacgtcccggacccgttagggttcagtacgttcgtcttacgtagtaccggcttaccgaagtctacgtaccctaccgaccggtaccctccgtaacgtccctagttccggttcccgggtactacccgtacgtaccgtacggtaacgggacggtacgtacttacgttaagtttactttagttaacggttaacttacgtaacttaaccgtaactaaaccggtacgttacgtaaccggttacgggtttggggtaccgggttaccggggacgggtaaccggtaccggtaacgtcgttaccggtaccggttaccgtaacgggttacccgtaacccgggaaccggtaccggtacccggttaccccggaccccgtttccggtacctacccggtttccccggttaccccgttaccccggtccccttacccgg

SEQ ID NO: 275017 - DNA, 781 bp, Homo sapiens
  misc_feature: GYAE6OF02GTTB5.27.23.C01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccccgngatggacgttggtgacttataactttatcgtgttggtaccgacacggaccctaggccactcgtaccccctaaactctatttctttagtgtattcggtacaggtaactccgggtacccccgtagggggttttcctagtacgttccgtcctttacgtacgttcggtccttaccgtaaagttccgtacggtacccttaccgaccggtccccttcccgtacgtaaccctacgttcccgtcccggggtccttacccgaacgtcccgtacggacgggtaaccggtacgggtcgttaggtaacgttttagtttacgttaggtttaggtttacctaacttaacgtaaacccgtaactcggtacgtaaccgtaacggtttggggttacgtttccggggacgggtacggggacccgtaaggccgttaacggaccccggttaccgtacgggttaccgacgggtaacccctaacggggtcccttacccggtacccccgttcccgggttaccgttacccgtttaccccgtcccggtttaccccccgtaccccgttaccccgg

SEQ ID NO: 275018 - DNA, 714 bp, Homo sapiens
  misc_feature: GYAE6OF02FYPBC.27.23.C01.1.454.CMB.1.raw
  modified_base (237)..(237): a, c, t, g, unknown or other
  misc_feature (237)..(237): n is a, c, g, or t
  modified_base (558)..(558): a, c, t, g, unknown or other
  misc_feature (558)..(558): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctctcactcagggcacgagggtcctgggcccagtctgccctgactcagcctgccctccgtgtcgtggggtctcctggacagtcgatcaccatcctcctgcacgtcggaaccccngatcggtacggttggtctacctttaattaactttatcgttggttacggtaccgaacgacggacccaggtacctacgtccgtaacccctaaaccttcgtacttttcttaagtgtattacgtcctaaaggtaccgtccccgggaccccggttaggggttttcacggtcttccgttacttaccgtagtcggtacctactacggtcctacgaccctaaccggcccgtacccctccgtacgtacctacgttcccggtccggtacctccgacgtccgtagggacggacggtcgtctaagttatttaacgtgtttcgttagacttaanacctaaacctacgaggtcaaccgttggtttgggtcgttacggggcggtacgtaacgcggtaccgtacggtcccgtctacgggtccaccgggaccacggtcccgttccccggtacccttggtccctaccgtccgttccccctaccgtaccctcccgg

SEQ ID NO: 275019 - DNA, 797 bp, Homo sapiens
  misc_feature: GYAE6OF02GOP06.27.23.C01.1.454.CMB.1.raw
  modified_base (217)..(217): a, c, t, g, unknown or other
  misc_feature (217)..(217): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatccaccatctccngcacgtcggacccgcgatggtacgttggtctcttaattactttatcgttggttcggaaccgacgaccggacccgagacctacctaccgtaacccctaacttcttaacgtttactttagacgtacttcggaactaacggtaccggttccccgggtacccggttagggtttccagtaccgttcgtacttagtacgtcgtactaccgttacgtccgtacgtcccgtaaccgtccgttccctaaccgtctaccgtaccgtcccgggtacccgtcttaccgaccggacggtaacggacggtacgttacgtactttaagggttaacctttagtccgtttacgtaactaaccgtaagtaaccttaaaccgtgtaacgggttaccggttacggtttcggggttaccgggggtcgggtaaccgggtacgggtaaccgtaaccggttacggtccgttaacccgggtaccgttaccgtacggacccggttaacccggacccggtttaccccggttccccggttccccgttaagttccccgttaacccgttcccggtttccccgtacccccggtttacccacgttacccggg

SEQ ID NO: 275020 - DNA, 698 bp, Homo sapiens
  misc_feature: GYAE6OF02FL0XH.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctcgtgtctgggtctctggacagtcgatcaccatctcctgcactcgggaaccccngatggtacgtttgggtgctttaattaactttatcgtgttggtaccgacaggaccccaggcactcgtaccccaaactcattctttatgatgtcagtaatcggccccgtagggttctgactcgtcttctatggctaccaatctgcctacacggcctcctcaccattccgtaccgggccttccgaacgtccgtacggacggaccggaggaccgttaggtactttagtttaacgttttaggttaacggtttcctaatttacgtaaccgtaaccgtaacgttacgaaccttacggtttacgggtttacgggtttcggggtaccgggtaacgggtacccggaaaggtccgtacggtaacccggtttaccgtaacggttacccggaacggtaccccgtaaacgggccttaccccggtccccgttaccggtccgttacccgttccctttaccgggttcccccttaacccgttccccg

SEQ ID NO: 275021 - DNA, 729 bp, Homo sapiens
  misc_feature: GYAE6OF02JKF0B.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctccaccctcctcactcgagggcacagggtcctcgggcccagtctcgccctgactcaagcctgccctccgtgtccgtggtcctcgtggacagtcgatccaaccagtcctccgtgacctacggtacgggaacccccgtgaacgtcggtacggttgggtcgttactttaattaacttttagttccgtttaggtttacggtaccggaactaccggaaccccgaaggtacctacgtaccggtaacccctaacgtcttaacttttcgttacgtagtagtcgtacctaaggtaccgtaaccccgggtaccccgttagggtttcacgtcgtcgtactttagtacgtccggtctaaccgttagtctccgacctacggtccgacccttccgtacactaccggttccgtccggcctacgaccgtcgaggaacggcgacgtctaggtattacgttattacgttgttactacgttaactaccgtaagtcgtaacgtaccgtacggtttcgtcgggtaacggggtcgggtaccgtggtaccgtcgtaccgtaccgtcgtacgtcgaacgtccgagtcccgtacgtacccgtacggcctacgttccgtccgttaccctaccgtacg

SEQ ID NO: 275022 - DNA, 904 bp, Homo sapiens
  misc_feature: GYAE6OF02GU1JW.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacgagggtcctgggcccagtctgccctgactcagcctgcctcgtgtctgggtctctggacagtcgatcaccatctcctgcactcggaacccgcgatcggacgttggtgtactttataacttttatcttggttcggtaccgacacggaccgaggacgtactcgtaccccaacttctattttacttatggtatacgtactaacgttaacgtccggtacccccgtagggggttttacctaggtacgttccggttccgtttaccgtacgttccggtaccgttaccgtaaaggttccgtcgtaccccgttaacgacccggttccccttaccccgtaccggaacccttaccgttcccggtaccccggggtccctaccccgtaaccggtcccgttacggggaacgggtaaccgggtaacgggtccgttacgggttaaacgttttacgttttaacggttttacggtttaacggtttaccttaaagttaaacccgttaaaccgtaaaccgttaacgggttaaccgttaaaccgttaccggggtttagggggtttccggttacccgggggtaacggggtaaccgggggtaaccgtaaccggggttcccgttaacccgggttacccgtttacccgggttaacgggtacccgtaaacccgggtaccccggtaaacccgggttcccgttcccccggttaccccccggttaccgggttacccccgttaaccggttcccccgttttaccccgtttaccccccgtaccccgtttaacccccgg

SEQ ID NO: 275023 - DNA, 818 bp, Homo sapiens
  misc_feature: GYAE6OF02FS2MA.27.23.C01.1.454.CMB.1.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
tcagagcgtcgtctcacgaccggtgctcgatttagtacacgtgattagggagttgggggggggtctcagggaggcagcgctcgtcgggacgtctccaccatggcctgggctctgctattcctcaccctcctcactcgagggcacgagggtcctgggcccagtctcgcctgacctcagcctgcctcgtgtcgtgggtcctcgtggactagtcatccacctntcctcgtgcacgtcggaacccgngtatcgtacggttggtctaactttagttaacctttgtacgttggttaccggtaaccgacgtacggaccccaggcctacgtacccgtaacccctaacgtctacgttttacttaagtgtgttcgtacgtaacggttcggtcccggtaccccggttagggtttcctcggaccgttcggtactttacggtacgttcggtacctaccgtaaggtcctacgtacccgtaacggcccgttaccctacctacgacctcggtcccggtaccgccgttacccgacggtacgtacgggaacggtcgggacgtcgttaacggttactttaacgtttggttaacgtttactaacttaagtaacccgtaacgtaacccgtaagttccggttaaccgttacgggttttcggggttcggaccgggggttccggaaacggtcccgggtacggttacccgtaccgggttacccggttaccgttacgggaacccgtacccggggtaaacgtcccggtcccgttaccccgggtacccccgttcggttaccccgtacccgttttcccggccccttttaccccccgcggttaccccg

SEQ ID NO: 275024 - DNA, 917 bp, Homo sapiens
  misc_feature: GYAE6OF02FMLCC.27.23.C01.1.454.CMB.1.raw
  modified_base (810)..(810): a, c, t, g, unknown or other
  misc_feature (810)..(810): n is a, c, g, or t
  modified_base (903)..(903): a, c, t, g, unknown or other
  misc_feature (903)..(903): n is a, c, g, or t
tcagagcgtcgtctcacgaccggtgctcgatttagtacacgtgattagggattggggggggtctcaggaggcagcgctcgtcgggacgtctccaccatggcctgggctctgctattcctcaccctcctcactcagggcacgtagggtcctgggacccagtctcgcccctgacctcacgcctcgcctccgtgtcgtcgggtcctcgtggactagtcgactccaccgtattcctccgtcgaccgacgtaccggaaccccgtgtacgttcggtaaccggttggtacgttacctttaactttaacgttttacttcggttacggtttacgggtaaccctaacggaaccggacccgtaccggcctaacccgttcccggtaacccccctaaatccgtaacgtttttacgttaactagtacttacggttaacgtaacggtaaccggtcccccggtaccccgggttagggtttctacgtacttccggttaacctgttacgtccggttaccaccgttaacgtcgttcctacccgtacccgtcccgttccctacccgtctaacccgtcccgttacccgggaccgttcccgaccgtacgtccgggaacggtaaccgggtacggtacgtccgtttaacgttaaagtttttacgtaaagttttacggttacctttaaagtaaaccttaaacccggtaactaaccgggttcgttaaacggttaccgttacgggggttttcggtaaccggggttcgggaacccggggttacgaacccgggttacggtcgttaaccccggttaacgggtaccccgttaggtaacccncccgggggaaccccttaaggttccccccgggtacccgtacccccggtttggaccccttttacccggttacccgtttccccccggtttaccccncgtttaacccccgg

SEQ ID NO: 275025 - DNA, 698 bp, Homo sapiens
  misc_feature: GYAE6OF02IPKF2.27.23.C01.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
  modified_base (588)..(588): a, c, t, g, unknown or other
  misc_feature (588)..(588): n is a, c, g, or t
  modified_base (687)..(687): a, c, t, g, unknown or other
  misc_feature (687)..(687): n is a, c, g, or t
tcagagcgtcgtctcacgaccggtgctcgatttagtacacgtgattagggattgggggggggtctcgagggaggcagcgctctcgggacgtctccaccatggcctgggctctgctattcctcaccctcctcactcagggcacgagggtcctgggccagtctgccctgactcagcctgcctcgtgtcgtcgggtcctcgtggacngtcgatcacatcgtcctgctacgtcgaccgngatgacgttgngtacttaatacttatcgttgttacggtaccgacgtacggaccaggctactccgaccctaaacgtctatttacttatggtactcgtactaacggtaacgtcccggtacccgttaggttacngtactcgtcttacagtcgtactaccgagtcncgtaccgtacgaccgtcctccgtacgaaccctacgtcccgggtaaccggtcctacccggtacgtaccggtagggtaacggacggtacgttacgtacggttatttatacggtttagtaacttacgaaacttagaaaccctacgtagtcggtaacgttacgggttgggtaccgtacggtgggacggtaaccgngtaccgtaccgtacgtcggaacgtccggacttaacccggacgttccgttacccggaccccgtttggaccctttaggtccccgtttacccgttacccccnccgtaacccgg

SEQ ID NO: 275026 - DNA, 664 bp, Homo sapiens
  misc_feature: GYAE6OF02JKXP5.27.23.C01.1.454.CMB.1.raw
  modified_base (165)..(165): a, c, t, g, unknown or other
  misc_feature (165)..(165): n is a, c, g, or t
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (310)..(310): a, c, t, g, unknown or other
  misc_feature (310)..(310): n is a, c, g, or t
  modified_base (374)..(374): a, c, t, g, unknown or other
  misc_feature (374)..(374): n is a, c, g, or t
tcagagcgtcgtctcacgaccggtgctcgatttagtacacgtgattagggagttggggggggtctcaggaggcagcgctcgtcgggacgtctccaccatggcctggctctgctatcctcaccctctcactcaggcacagggtcctgggcccagtctgccctgacncagcctgcctcgtgtctgggtctccgtaggcagtcgatcaccatcctctgccacgtcggaacccncgaatgtaccgttggtnacttaattaacttatcgttgttcgtacgacgacgaccgtgctacgtacgtaccccaaactctntttattactatactgtaccagtaacgtccggtacccgtagggttcctgactcgtacttaccgtntacgtcctactacgtcgtcctacccgtacgaccgtaccctcgtaccgtactaccgtccgtcgtccctacgtacgccgtaggacgtagtcgtagtacttattacttagttagttacgtttctaaacttcgaactacgtgttacacgttacgggttacgggtgttacgggcgggtacccgaggtcgaacgttccgtacggttccgtaacgtaccggccgaaccgttacggcccgtaccccgtcggtacccggtaccttcgtaccccggttaccgtccccttacccgtaccgg

SEQ ID NO: 275027 - DNA, 753 bp, Homo sapiens
  misc_feature: GYAE6OF02FOTGY.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
  modified_base (386)..(386): a, c, t, g, unknown or other
  misc_feature (386)..(386): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtncttataactttatctgttggtaccgacaggacccaggcactcgtacccaaactcattctttangatgtacaagtaactccggccccgtaggggtttctgtatcgtctttctagtcggtactaccgtaagtctcgccctaacncggtcctaccctagacctactccgtccgggcctccgaacgccttaggacgggaccggtagggccttagtaacgttttaactttagtttacggttacgtttactaattaacgtaaaccctaaccgtaacggttacgtaaccgttacgggttttacggggttacgggttttaccggggacggggtaacgggggaacccgtaacggggtaccgttaccgggtaaccccggtttaccggtaacgggttacccggaaccggtaaccccgggtaaaccgggtcccgttacccggttacccccccggttacggttacccgttaaccccggtttccggtccccggttttaccccccggtccccccgtttaccccg

SEQ ID NO: 275028 - DNA, 880 bp, Homo sapiens
  misc_feature: GYAE6OF02FEKCD.27.23.C01.1.454.CMB.1.raw
  modified_base (132)..(132): a, c, t, g, unknown or other
  misc_feature (132)..(132): n is a, c, g, or t
  modified_base (174)..(174): a, c, t, g, unknown or other
  misc_feature (174)..(174): n is a, c, g, or t
  modified_base (481)..(481): a, c, t, g, unknown or other
  misc_feature (481)..(481): n is a, c, g, or t
  modified_base (706)..(706): a, c, t, g, unknown or other
  misc_feature (706)..(706): n is a, c, g, or t
tcagagcgtcgtctcacgaccggtgctcgatttagtacacgtgattagggagttgggggggggtctcaggaggcagcgctctcgggacgtctccaccatggcctgggctctgcttacttcctcacccttccnctactcgaggcacgtagggtctgggcccagtctcgcctgctnacgcctgcctccgtgtctcgggtcctccgtagggacctagtcgactccgaacctacttccgtccgtcgaccgtaacgtaccgggaacccccggtgacttcggtacggttttcgggttactaaccttttaactttaaacctttcgttccgtttacgggttacccggtaaccgaccggtaccggaacccgtacggacctaccgttacccggtaaaccccctaacgttcttaaccttttacgttagtacgtacgttcgtaaaccgttacgggtaccggttccccgggtaccccggttaggggttttaccnggtaaccttccgtttactcgttcggtacgtccctaacgtaacggttccctcggtaacccgttaccggacccgtcccttaccgacttacccgtcgttcccgggccgtcctaggtacccgcggtacggaacgggtctacggtcgttatttaaactttacgagttttacgactaacttaacacggtaaaccctaggtcgtaccgttaacgggtgggttttacccgggnggggttaccggtaaccggggtaaccgtactacggggtccctttaaacccgggtcttacccggggttgaaaccccggtccgggaaccgtttaaccccggggtcccgttaccccggacccggttttgaccccgtttacccggtttcccggacccccggtttccccaaccttccggg

SEQ ID NO: 275029 - DNA, 715 bp, Homo sapiens
  misc_feature: GYAE6OF02G50MO.27.23.C01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggacccngatgacgttggncttataactttatcttgttggaccgacgacggacccaggcactcgtaccccaactctatttcttatgactgtctaagtacgtccggtccccgtagggtttcctgtactcgtcttacgtagtcggtactccgtaagttctacgtaccctacgaccggtcccttacccgtagaccctacgttcccggtacccgggtcctaccgacgtcccgtaggaacgggtaccgaggtctagttaatttacttagtttagttaagtttactaactacttaaccgtaaccgtgttacgtaccgttaacgggtttcggggtacgtttaccggggacggggtaacgggaccggtacgggtaccgtaccggttacccggttaccggtaacggttaccgacgggtaccccgaaggttccccgtcccggtacccccgtttcgggtacccttccgttaccccgtttccccgttacccctaccccttcccg

SEQ ID NO: 275030 - DNA, 755 bp, Homo sapiens
  misc_feature: GYAE6OF02JQDBY.27.23.C01.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
  modified_base (326)..(326): a, c, t, g, unknown or other
  misc_feature (326)..(326): n is a, c, g, or t
tcagagcgtcgtctcacgaccggtgctcgatttagtacacgtgattagggagttggggggggtctcaggaggcagcgctctcgggacgtctccaccatggcctgggctctgctatcctcaccctcctcactcgagggcacacgggtcctgggcccagtctgccctgactcagcctgcctccgtgtcgtcgggtctccgtggacngtcgatcaccngtcctctgacactggaaccccgngatgacgttggcgacttaattacttcgtcttggttcggtaccgtacgacggacccaggctactcgtacccaaatctacgtttctttanggtactcgtacaggttaaccgcccggtaccccgttggggtttacacgtacgtccggtactttacgtacgtccggtacctaccgttaagtccgttaccgtacccacggttaacccggtcccctccgacgtacccgtacgttcccggtccccgggcgttaccgacccgtacggttaccgggaacggtaccgggtacggtaacgttccgttaaagtttacgtttaacgtttagttaacggttaaccttagttaaccgttaaacacgtacgtccgtaacttaccgggtttgggtaccgggtttaaccggacgggttaacccgggacggtaggttcccgaccgttaccgtaccggtacgtaccgcgacccgtaggtccccgtaaccggttcccgtaccggtctaccgttcctacccggttcccacccgtacccg

SEQ ID NO: 275031 - DNA, 719 bp, Homo sapiens
  misc_feature: GYAE6OF02GYIK9.27.23.C01.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (489)..(489): a, c, t, g, unknown or other
  misc_feature (489)..(489): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctggccctgactcagcctgcctcgtgtctggtctcctggacagtcgatcacntctctgcactcgaaccngatgacgttgngtcttataactttntcttgtcgtacacgacgaccnggtccacgtcgaccccaatctaactttcttatgtatcgtacgtaacgtaacgtcccggtaccccggttagggtttcctagtaccgttccgtcgttactcgtacgttcctaacgtacgttcctcgtacccgtaccgtacccggtccctacccgtacgtacctcgttcccggtccggtaccgtaccgtacggtccgtacggtaacgggaccggtacgtntaacgttatttacgttacgttcgttaacgttctaaacgtactaacgtaacgttagtacgttaccgttaggtttcggggtccggttcgggaacgggtacggtaacggtccgtacggtaccgtaccggttaccgtacggttaccggaccgtaaccgggtacggtcccgttaccccggtcccgtacgttcccgtacccgttaccgttccccggttaccccaccgttaccccgg

SEQ ID NO: 275032 - DNA, 890 bp, Homo sapiens
  misc_feature: GYAE6OF02GZQFG.27.23.C01.1.454.CMB.1.raw
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtcgtggtctccgtgacagtcgatcaccatcctctgcacgtcggaaccgngatcgtacggttggtgtacttataactttntcgttggttcgtaccgacgacggaccgaggcactcgtacccctaactctactttcttagacgtatagtactaacggtaacctcccgggtaccccggttagggttttccgtagtaccgttccggtcttcgtacgttcgtaccgtaccgtaacttcgtaccgtcccgtaccggtacccggccctttcccgtacgaaccctaccggtttcccgtcccgggtacccttaccgacccggtaccggtaccgggaaccggggacgggtaccggtaccgttaggttaaaccgttttaacgttttaacggtttaacggtttacgtttaaccgtttaactaaaccgttaaacccgtaaaccggtttaacgtaccggttaaccggttaccggtttcgggggtttaaccgggtttaccggggacccgggggttaaacggggacccgggttaacggtcccgggtacccgggttaacccggttccgggttaacccggtaccggtaacccggtaccccggtaaaccgggtcccccggttaaccccgggttaccccccccggttacccgggttacccgttaccccggtttaccccggtttaccccccggtttaccccccggttacccccgtttaacccccggg

SEQ ID NO: 275033 - DNA, 774 bp, Homo sapiens
  misc_feature: GYAE6OF02JQX7U.27.23.C01.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (570)..(570): a, c, t, g, unknown or other
  misc_feature (570)..(570): n is a, c, g, or t
  modified_base (755)..(755): a, c, t, g, unknown or other
  misc_feature (755)..(755): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggccacgtagggtccgtgggccctagtctcgccctgactcagcctgccctcgtagtcgtacgggtctccgtggaccagtcgactcactntcctactgactacgtcggaacccgtgatcgtacggttgcgtacttataactttntcgttcggttgaccgagtacggaccgcgactctccgaccctaatcgtatttccttacgtggtacttcgtacgtaacgttaaccgtccccgggtaccccggtttaggggtttaccctgaaccgttccgttaccgttacttacggtaacggttcccttaaccgtaaggttcccgttccgttaacccggtaccggtaacccgtcccgggttaccctacgtaaacccgtcggttcccgtacgggccctacggaccgtccggtagaacggggaccgttggtacgtagttaaccgttnttaacgtcgttactacgtacgacttacgaccgtataccggtaacgtggttccggtacgtccggggtaacgacgggtaccgagttaacccgtcgttacccgtacgggtaccgtccggtaaaccggtcccgttagggcccgttacccccgtcgggttacccttcggtaaccccgttcggttttaccnccccccgtaagttccccgg

SEQ ID NO: 275034 - DNA, 812 bp, Homo sapiens
  misc_feature: GYAE6OF02FVKJ2.27.23.C01.1.454.CMB.1.raw
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcacctntctcctgccacgtcggaaccccgngatgtacgtttggctctttaatacttatcgtagttggtaccgacgtaacggacccaggacctacgtccgtacccctaaactcgtactttacgttatggtacttgtacgtaacgtaaccgtcccggtacccccggttaggggttttcctcggtaacgttccggttcttacgttagttccggtccttaacccgtaagttccgtaccgtcccttaacccggtaccgtccccttccgtaccgtacctacgttcccggtccgggacctcccggactcccggtaggaaccgggtacgtacgggtcttacgggtaactttacgttacgtttcggttaactttactacgttaacgtaaacgtaccgttaaggcgttaaacgttcgggttacggggtttcggggtttaccggaccgggtacggggtaaccctacgggttccaaccgggtttaccccgttaccggttacgggtaaccccggtcggaaacccccggttcgggtaccccgttacccgttccccccgggttaacttcccgggtaacccttttccccggttacccgttaccccccgtaccccgttaccccgg

SEQ ID NO: 275035 - DNA, 783 bp, Homo sapiens
  misc_feature: GYAE6OF02GNMUN.27.23.C01.1.454.CMB.1.raw
  modified_base (245)..(245): a, c, t, g, unknown or other
  misc_feature (245)..(245): n is a, c, g, or t
  modified_base (379)..(379): a, c, t, g, unknown or other
  misc_feature (379)..(379): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtcctctggacagtcgatcaccatctcctgcacgtcggaacccgcatggacgttggngtacttaataactttatcttggttacggtaaccgacgtacggacccaggctactccgtaaccccaactctattctttaatgtatgtcaagtaacgtcccggtaccccgtaggggtttctagtacgtcgtacttntagttcggtctaccgtaagttccacggtaccctaaccgccggtacccttcccgtacgaaccgtactcccgggttacccggtcctacccgtacgtcccgttaagggaaccggggtaaccgggtacggtactttacgggttaaattttacgttttaaggttaacgtttacgttaacttaaacgttactaaaccggtaacctaagtacgtaacccgttagggtttacggggttacgggttcccggggtaagggttaacccggggaagttaccgggaccgttaaccgggtacccgttacgtacggttaccgacccgggtaacccgtacgggtaccctccccgggttaccccttaccgggttaccgttaccccttaccggtacccctttaccccgtacccctaacccgg

SEQ ID NO: 275036 - DNA, 772 bp, Homo sapiens
  misc_feature: GYAE6OF02HP6TC.27.23.C01.1.454.CMB.1.raw
  modified_base (657)..(657): a, c, t, g, unknown or other
  misc_feature (657)..(657): n is a, c, g, or t
  modified_base (739)..(739): a, c, t, g, unknown or other
  misc_feature (739)..(739): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtcctccgtggacacgtcgatccacctatcctcctgaccactcgggacccctgattggaccggttggtcgtactttaatttaaccgttttacttcgttaggtttacgggtaacccgacgaacgggaaccccgaggcctaacgttccgtaaccccctaaacttccgtaacttttacctttagttgtaacgttcgtaaccgtaggttaaaccggttccccgggacccccggtttagggggtttcctgtaacgttcccggttactttcgtaacggtcgtaccctacgtaacggttcctaccgtacccgtaccgaccggtcccttacccgacgtaccctacgtacccggtcccgggtacctaccgaccgtaccgtacgggacgaccgggtaggtcttaaggttactttaagttagttcgttagttaccattaacaccagtacgtacgtaccgttagttcgggtcgttacgggngggtaaccgacgtcgtacgtccgtaccgtcgttacggtaccgaaccggcccgtaaggcccgttcccgtacccgtcgtaaccnccgtttacccgtccttcccccgaacccttccgg

SEQ ID NO: 275037 - DNA, 787 bp, Homo sapiens
  misc_feature: GYAE6OF02HL77E.27.23.C01.1.454.CMB.1.raw
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (267)..(267): a, c, t, g, unknown or other
  misc_feature (267)..(267): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacngtacgatcaccatctcctgcacgtcggaaccgngactgtacggttggtcgtacttattaactttntcgttagttacggtaccgacgacggaacccagggtaccaccgttacgtaccccctaaactactaacgtttacttagtaggtacgttcgtacgtaagttaccggtacccgggtacccccggttaggggttttctagtacgttccgtactttacgtacggtaccggtacccttacgtaacgttcctacggtacccgtaccggtacccggtccccttacccgtaacgtcccgtaacgttcccggtacccgggtacctacccggtaccgtccgtacgggaacggtaccgggtacggtcttaaggttaacgtttacgttagttacgtttaagttaacctagttaaccgttaaccgaacgttacggtactaaccgggttacggttcgggttacgggttacgggacggtacgggaccgtaggtccggtacgtaccgttcgtacgggtacaccggtaccgtacgggtccctacccggtacccgtcggtaccacccgttccgttaacccgttccccgtaaccctcccgg

SEQ ID NO: 275038 - DNA, 833 bp, Homo sapiens
  misc_feature: GYAE6OF02FNO6B.27.23.C01.1.454.CMB.1.raw
  modified_base (173)..(173): a, c, t, g, unknown or other
  misc_feature (173)..(173): n is a, c, g, or t
  modified_base (195)..(195): a, c, t, g, unknown or other
  misc_feature (195)..(195): n is a, c, g, or t
  modified_base (236)..(236): a, c, t, g, unknown or other
  misc_feature (236)..(236): n is a, c, g, or t
  modified_base (336)..(336): a, c, t, g, unknown or other
  misc_feature (336)..(336): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctcgccctgactcancctgcctcgtagtctgggtccncgtggacagtcgatcacatctcctgacaccgtcggaacccncgatcgtacgttcggtctacgttaacttaactttagtcgttaggtcgtaaccgaacgtaccggaaccgaggtcctaacttccgtaacccccgaaaacttntaaccgttttctttaagtacgtagtacgttaccgtaaggttaaccgtaccccgggccccgtttaacgggggttttcctaagtccgtccgtttacgttctacggttacgaccgttaccttaacggttccacggttccccgtaaacgtccggtcccctacccgtacgaacccgttctccggtcccgggaccttaccgtaacgccggttaagacgggtcggtaaccgggttcttaaccgggtaattttaacggttattacggtttaaacggttactaaacttaccgtaaccgtaaacggttacggtacgttaccgttaacgggtttccgggtcgggtttaccggggaaccgggtaggtacccgggtagtaccggttcccggtaaccgttccggtaacgttccggaaacccggcccggttaaacggtccccggtccccgtaacccgttaccggttactacccgggtttacccttacccggttacccccgttaccgtacccg

SEQ ID NO: 275039 - DNA, 954 bp, Homo sapiens
  misc_feature: GYAE6OF02HE41G.27.23.C01.1.454.CMB.1.raw
  modified_base (465)..(465): a, c, t, g, unknown or other
  misc_feature (465)..(465): n is a, c, g, or t
tcagagcgtcgtctcacgaccggtgctcgatttagtacacgtgattagggagttggggggggggtctcaggaggcagcgctctcgggacgtctccaccatggcctgggctctgctattcctcaccctcctcactcgagggcacgagggtcctgggcccagtctgccctgactcagcctgcctccgtgtcgtgggtcctcgtggacagtcgactccaaccattcctccgtgcctaaccgtaccgggaaaccccgtcggaattacgggtaaccgggtttgggtacgtaacctttaaattttaaaccgttttatccggttagggtttaccgggtaacccgaaccggaaccgggaccccagggacctaccgttacccgtaccccctaaaacttacttaacttttacgtttatagtacgttacgtacgtaacggttaaccgtccccgggtaccccgggttaggggtttcnggttacgtccggttcttcggtacgtcggtaccctacgtaacgttccgtaccgtaccctaaccgtacccgggttccccttacccgtaacgtacccgtacgttccccgggtcccgggtacccttacccggaccgggtaccgtacgggggaaaccgggtaccggttaacgggtcgttaaagttaaccgtttttaaggtttacgtttacgggtttaaactttaactaacgttaaaacccgttaccggaaactttacgggtaacggttaaaccggtttcggggtttaggggttaccggggttcggggaaccggggtaaccgggttacggtaccgggtcggttacccgggtaccgttacgggtccggtaacccggtaccggtaacccggtcccggttaacccccggttcccggtaacccccggttcccgggttaacccgtttacccccgttaccccgggttttacccccgttaccccccgtacccccggtttacg

SEQ ID NO: 275040 - DNA, 800 bp, Homo sapiens
  misc_feature: GYAE6OF02FFC8G.27.23.C01.1.454.CMB.1.raw
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcaggcacagggtcctgggcccagtctgccctgactcagcctgcctccgtgtcgtgggtacctccgtggacaggtcgatcgaccatcctcctggcactgggaaccccgngatggacgttggtgccttatactttntctgttcgtacgacacggaccaggccactaccgtaccccaaactcatttctttatgaatcgtcaaggtaacgtcccggaccccgtaggggtttcctagtactcgtcttcgtagtcggacttaccgaatcgtcgacccctaacgccggtccctacccgtcaaaccgtccgtaccgtcccggggtacctacccgtacggaccgttcgggaaccggtaaccggtaacggtccgtaacgttaacgtttaagttacgttttaggtaaccgtttaacggttaaactaaaccgtaaccgtaaaaccgtacggttaaccgtaaccgtacgggtttacggggttacggttccggggtaaccgggaacggggtacccgtaagggtcctacccgggtacccgttacccggtaacggtacccggtaaccgggaccccgttaaaccggggtccccgttaccccgggttacccccgttaccgggttaacccccgtaaccgttccccggtttaaccccggtcccccccttaacccgttaaccccccggg

SEQ ID NO: 275041 - DNA, 722 bp, Homo sapiens
  misc_feature: GYAE6OF02JPJ40.27.23.C01.1.454.CMB.1.raw
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
  modified_base (339)..(339): a, c, t, g, unknown or other
  misc_feature (339)..(339): n is a, c, g, or t
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (539)..(539): a, c, t, g, unknown or other
  misc_feature (539)..(539): n is a, c, g, or t
  modified_base (627)..(627): a, c, t, g, unknown or other
  misc_feature (627)..(627): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctctcactcagggcagagggtcctgggcccagtctcgccctgactcagcctgcctccgtgtctcgggtctccgtggacagttcgatcaccgatcctctgctacgtcggaaccccngactgacgttgtcgacttaagtaactttntcgtgtttcggaccgtaacgaccggtaccgaggacctacgtaccgtaccccgtaaactctaatttcgttaancgtagtcggtactaaggtaccgtaccgggtccccgttacgggtttcncggacttcgtcttacgtntcggtacctacgtacgccgtcgaccgtacgtcccgactccccgtagtacctaccgtccgtaccggtactcccggagtccggtagacgggtaaccggtcgacgttacgtaaacctttgtaacgttgttaaccgttntaaacgttacttaacgaaccggttgaaaccgtacggttacggttttagggtccggttaccggggaccggtcgggtaaccgtaccggtnacccgggttccctacggttataccggaacccgctacggtcccgtacccgtaccccgtcggtaccttccgtacgtttcgtacccctcgtaaccccg

SEQ ID NO: 275042 - DNA, 602 bp, Homo sapiens
  misc_feature: GYAE6OF02FQJH8.27.23.C01.1.454.CMB.1.raw
  modified_base (510)..(510): a, c, t, g, unknown or other
  misc_feature (510)..(510): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccccgcgaatggaccgtttgggtctacttaattaaccttttattcctgttggtaccgacaggaccccaggccactcgtcccccaaactcattctttatgatgtcagtaatcggcccctagggtttctgatcgcttctatcggctcaagtctgtcctacaccggtccctccctgaccctagtcccgtaccgggtctcccgagtccgtgacggacgaggctagatttacttagttgttacgttctaattataacaacctagtcgactaacgttggggtgttcggngggaacgggaccgaggctgtaccgttcacggtcacggacccgtaagccgtcgccccgttacggcctaccgtccgttccccgccctcctaccg

SEQ ID NO: 275043 - DNA, 704 bp, Homo sapiens
  misc_feature: GYAE6OF02F4PC6.27.23.C01.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (350)..(350): a, c, t, g, unknown or other
  misc_feature (350)..(350): n is a, c, g, or t
  modified_base (412)..(412): a, c, t, g, unknown or other
  misc_feature (412)..(412): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactcggaacccngatgacgttggtgtcttaataactttatctgttcggtaccgacacggacccaggcactcgtacccccaaattcactttctttatgtatgtacaggtaactccggccccgtaggggttcngtactcgtctcgtatcggtcctcaagttctcgtacctaacgccgtccctccctcgaaccctntcccgtacccgggtcctcccgaagtcccgtagggacgggtaccggtacggacttacgtaacttttaacgttaagtttacggttaactttagtaaacttaacttaaaccgtaaaccgtaggttacgtaaccgttcggtttaaggggttccggtttacggggaccgggtacgggtaaccgaggttcccgtacggtaccggttccgtaacggtcgaacccggtacccggtaacggccgttacccggtcccccgttaggtccctaccgtccgttcccggttccccgaccttacccg

SEQ ID NO: 275044 - DNA, 924 bp, Homo sapiens
  misc_feature: GYAE6OF02JC8QN.27.23.C01.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (513)..(513): a, c, t, g, unknown or other
  misc_feature (513)..(513): n is a, c, g, or t
tcagagcgtcgtctcacgaccggtgctcgatttagtacacgtgatttagggtaggttaggggggggtctcaggaggcacgcgctctcgggacgtctccaccatggcctgggctctgctattcctcacctcctcactcgagggtcacgtagggtcctgggcccaggtctggccctgactcagcctgcctcgtgtctcgggtctcctggacngtcgatcaccatctcctgacctacgtcgggaaaccccnggtaactcggtaacggttttggcgtaccttttaaagttaaccttttatccgtttagggttttccggaaccggaaccgacggggtaacccccgaggtccctaaccgttaccggtaccccccctaaaattccgttaaacttttcccgtttttaaagttcggaacgttttacggttaccgttaaacggttaaaccgttcccccccgggggaacccccgttttaaggggggtttttaacctggggtacctttccgtccggtttttaacnggttccggtacccttaaccgtaaccgttccggttctaaaccccggttaccgaacccgggttcccccgtttacccctaacggggttaaccccttaacggtcccgggttacccgggtacccgtacccgtaaccgttacccggttacgggaccggggtacggtacggtccttaagttaacggttttaactttacggtttagttacggtttactacgttaactaccgtaacgtggtaccgtaacgttcggttacgggtcggttacgggacgggtacgggtaactcggtaccgtaccgttacccggtctacgggtacccgaaccggtcccggtaacgggtcccttaccccggtccccggttcccggttacttaaccccggttccgtttacccccggtaccccgtcccttaacccgg

SEQ ID NO: 275045 - DNA, 724 bp, Homo sapiens
  misc_feature: GYAE6OF02GA5VA.27.23.C01.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (276)..(276): a, c, t, g, unknown or other
  misc_feature (276)..(276): n is a, c, g, or t
tcagagcgtcgtctcacgaccggtgctcgatttagtacacgtgattagggagttgggggggggtctacaggaggcagcgctctcgggacgtctccaccatggcctgggctctgctacttcctcaccctcctcactcagggccacgagggtcctaggggcccaggtctcgccctagactcacgctcggcctccggtgtcgtgggtctcgnggacagtcgtancaaccntctcncgcacgcggaacccngtatcggtacgtgtatactttataacttntcgttggttacgacgtacgcggaccaggtcctctaccggacccttaagtcttacttacttacgagtcttgaactaggtaccgtcccggccggtttgggttactgtactacgttcttaggtcgtccggtacctacgtacgtccggtatacccgtaacggtcccgtccgttaccgcccgtatccccggttccgggtccgaccggttccaaccgggtcggttaacgggaccggacgtacgttcgtacgttaaatttacgttggtttaagttccgtaactaaggttaacctaacccgtacgtacgttacgtaccggtttgggttaccgggtcgggttacgggacgggttacgcggtacgaccgtacgttaccggctacgggtacaccgaccggttaccgtccgtaaccggtcccgtactacgttcccgtactccccggttacctcgtacccg

SEQ ID NO: 275046 - DNA, 740 bp, Homo sapiens
  misc_feature: GYAE6OF02HCDCQ.27.23.C01.1.454.CMB.1.raw
  modified_base (206)..(206): a, c, t, g, unknown or other
  misc_feature (206)..(206): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (337)..(337): a, c, t, g, unknown or other
  misc_feature (337)..(337): n is a, c, g, or t
  modified_base (637)..(637): a, c, t, g, unknown or other
  misc_feature (637)..(637): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccaggtctgccctgactcgacgcctgcctccgtgtcgtgggtctcctggacngtcgactccacctactctcctgccacgtcggaaccccgtgatggacggttggngtacttataactttntcttggtacggtaccgacgacgacccgaggcaccgtccgtaccccaaatcttaatttcttaancgtatttcgacgtaagtaaccggtcccggccccggtttagggttactcgacgttccgtactttccgttaatccggtatacccgtaagtccgttaccggaccttacccgcccggtcccttcccgacgttacctacgtccgggtcccgctaccgtccgcgtacggaacgggtacgcggttactagttaacgtttgtttacttagttaccgtttataacgttaacttaacgaaaccttcgtaacgttaccgttaacggggtttcgggttaccggggttacgggaccgggtaagtaacccgggnggttccgtaccggtaccggttaccggaccgttaacgcccggtaacgacggtcccgacccggtcctaccggtctacccttccgtcccttacccgcccttaccgg

SEQ ID NO: 275047 - DNA, 746 bp, Homo sapiens
  misc_feature: GYAE6OF02HBKNQ.27.23.C01.1.454.CMB.1.raw
  modified_base (275)..(275): a, c, t, g, unknown or other
  misc_feature (275)..(275): n is a, c, g, or t
  modified_base (341)..(341): a, c, t, g, unknown or other
  misc_feature (341)..(341): n is a, c, g, or t
  modified_base (477)..(477): a, c, t, g, unknown or other
  misc_feature (477)..(477): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctctcactcagggcacagggtcctgggcccagtctgccctgactcagcctgcctcgtgtcgtgggtctccgtggacagtcgatcaccgtattcctccgtgacctacgtcgggaaccccgtgattcgacggttggtctacttattaaactttntcgttggttacggtaaccgacgacggtaccacggtcacgttaccgtacccaactctatttctttangtatgtacatacgtccgtccccggtagggtttctagtactcgtacttcgtcgtcgtacctacgtagtccgtccgtaccgtaaccgtccggtcccttacccgtaccgtaacctcccggttcccggtcccgggtaccnccgtacgtcccggtaggggtaccggaaccgtgggttactaggttactttacgtttacgttgttaactttacgaacttacgtaaccgtacgtacggttacgtacgtttagggttcgggttacgggttccggggaacggtcggaacgtcgggttccgtaccggttcccgtacggttacggtaccgtaaccggtccggtaacggtcccgttcccggttacccccgttcggtaccgttcccgtttccggcccctttccccggaccttccccgg

SEQ ID NO: 275048 - DNA, 802 bp, Homo sapiens
  misc_feature: GYAE6OF02GD7CE.27.23.C01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
tcagagcgtcgtctcacgaccggtgctcgatttagtacacgtgattagggagttggggggggtcgtcgaggaggcagcgctctcggacgtctccacatggcctgggctctgctatcctcacctcctcactcagggcacgtaggtcctgggccagtctgcctgactcagcctgcctccgtgtctgggtctccnggacagtcgatcaccatctcctgcactggaaccccngtatcgacgttgngtacttataactttntctgtagtacgtcagacccaggcagtcgtacccaaactcgaatttctttactaggattacgtacaagttaatccgggcccccgtaaggggttttctacggtaactcggtaccttacgtaacgttcggcttaccgaaacgtttcggtaaccgtcccgtaacggtaacccgggcccttaccccgttacgaacccgttaacgttcccggttacccggggtccgtaccccgtacggtaccccgttagggtaaccggggtaaccggacgggtaccgtttacggtaacgtttaacgtttagtttacggtttaacggtttacctttaacgttaaaccgttaaaccttaaaccggtaacggttaccggtaaacgttaaccgggtttcgggtttaccggttaacggggtaccgggtacgggtaaacccgggtagggttacccgtacgggtaacccggtttcgtaacggtaccggtaacggacccggtaaacgtccggtaccgtaccccggttacgtccgtaccgttacgtcccggttttaccgccccttacccgg

SEQ ID NO: 275049 - DNA, 712 bp, Homo sapiens
  misc_feature: GYAE6OF02GJV9E.27.23.C01.1.454.CMB.1.raw
  modified_base (141)..(141): a, c, t, g, unknown or other
  misc_feature (141)..(141): n is a, c, g, or t
  modified_base (178)..(178): a, c, t, g, unknown or other
  misc_feature (178)..(178): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (432)..(432): a, c, t, g, unknown or other
  misc_feature (432)..(432): n is a, c, g, or t
  modified_base (523)..(523): a, c, t, g, unknown or other
  misc_feature (523)..(523): n is a, c, g, or t
tcagagcgtcgtctcacgaccggtgctcgatttagtacacgtgattagggattggggggggtctcaggaggcagcgctctcgggacgtctccaccatggcctgggctctgctacttcctcaccctctcactcagggcacgngggtcctgggcccagtctcgccctgacctcagcctcnccttccgtgtctgggtcctccgtggacagtcgactcaccatcctcctgacncgtacggacccgnatgtacgttggntcttatacttntctgtcgtacanacggccagcactcgacccaactcgtattactttanacgtatcgtcaaggttaactcccggcccggttgggtttacngtactcgtacttctgtcgtctacctacgttctcgacccttaccgccgtcctccgtcgtcctacgtacccgtcccgtacncccgaacgtccgtggaacggcggtacgttactagttaacgtttagttacggttactttaacggtaacttacgttaactaccgtaacggttntaacccggttacttcggggtttaaccgggttcggggtaccggggtacgggtacccgggtaacggtaacggttacgtcccgggtaaaccgttcccgtaggacccgacggtacccggtaccgtacccgtcccggttaacccgttcccggtacttccttacccggtttcccgttacccgtaccccttacccg

SEQ ID NO: 275050 - DNA, 788 bp, Homo sapiens
  misc_feature: GYAE6OF02G3PW1.27.23.C01.1.454.CMB.1.raw
  modified_base (134)..(134): a, c, t, g, unknown or other
  misc_feature (134)..(134): n is a, c, g, or t
  modified_base (396)..(396): a, c, t, g, unknown or other
  misc_feature (396)..(396): n is a, c, g, or t
tcagagcgtcgtctcacgaccggtgctcgatttagtacacgtgattagggattggggggggtctcaggaggcagcgctcgtcgggacgtctccaccatggcctgggctctgctattcctcaccctcctcactcngggcacgacgggtcctcgggcccagtctcgccctgacctcacgcctgccctccgtggtcgtcgggtccttccgtggacagtcgatccaccacgtcctcgtgacactaccgggaaccgccgagttacgtaccggttggtcgttacctttaaactttaacgtttcgtttcgttacgtttcggtaaacccgaaccgtaaccgggaaccccaggtaccctacccgttaaccctaacccccctaaactccttattttacgtttacgnggttaacttcgttaaccgaccgttaaccggtccccgggtaccccgggtttagggtttaccacgttagttccgtaccttctaggtccgttacctaccgaggttcctacctacgtactacccggtccctacaccggtaactacccggtccgtcccggtcccttcgaccgtcggtaacgggaacggcggtaaccgtactttagtaacgttttattaacggtttagttaacgttactaacgttaacctaacctaccgtgtaaccgttccggttaagggttccgggtacgggtacggacgggtacgcggtacgtcgtaccggtcgacgtaacgccggaacctccggccgtcctaccgtcccgttgtcccttacgttccgtcttaccctccgttaccg

SEQ ID NO: 275051 - DNA, 788 bp, Homo sapiens
  misc_feature: GYAE6OF02GP2M4.27.23.C01.1.454.CMB.1.raw
  modified_base (226)..(226): a, c, t, g, unknown or other
  misc_feature (226)..(226): n is a, c, g, or t
  modified_base (271)..(271): a, c, t, g, unknown or other
  misc_feature (271)..(271): n is a, c, g, or t
tcagagcgtcgtctcacgaccggtgctcgatttagtacacgtgattagggagttggggggggtctcaggaggcagcgctctacgggacgtctcccaaccatggccgtgggctctgctattcctacaccctctcatcaagggcactagggtcctcgggacccaggtctacggcccctagaacctcgacgtcctcgccttccgtagtccgtggtacctccgtaggacngttacgactccgaactactcctacctgaccacgtacggaacccgnacgttcgaggtttcggtcaatttaacgttaactttgtcgttacggttcgaccgtaacgcggtaccctaggtactacgtaccgtaacccctaacttcgtactttacttagtgtacttcggtactaacgaccggtcccggtacccggttaaggttcgcgtaacgtcgtacttccgttaggtccggtacttacgtacgtcctacgtcgtaacccgtccgtacgtaccgtaccaaccgtcgttcccggcgttcccgaacctacggtcgaaaggtcggtaccgacgtagttaggttaaccttagttacgttacgttaacttacaaaggttaaccgtaaccttacgggtaactacggtaaccgttggttcggggtacggttccggaacggggacgtaccgacggtcgacccgtaccggtcggttaaccgaccggttaacccggaccgtaccggggtacccgtttccccggaaccgttccggtcttaaccccggttccgttaccccgttacccctgtaaccccg

SEQ ID NO: 275052 - DNA, 837 bp, Homo sapiens
  misc_feature: GYAE6OF02JTIDI.27.23.C01.1.454.CMB.1.raw
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
tcagagcgtcgtctcacgaccggtgctcgatttagtacacgtgattagggagttggggggggggtctcagggaggcagcgctctcgggacgtctccaccatggcctgggctctgctattcctcaccctcctcactcgagggcacgagggtcctgggcctagtctcgcctgactcagcctcgcctcgtgtcgtgggtctccgtggacacggtcgatccacctacttcctccctgaccaccgtaccgggaaccccgcggtaactcggtaccggtttcgggtctaccttttaatttaaaccttttnttcgttaggttaccgtaaccggaccgtaaccggaacccgtacggaccgtaaccgttacccgtaacccctaacttactaacttttctttaagnggtagttcgtacgtaacgttaaccggtcccggaccccggtttagggttccacgtaccgttccgtttactcgttacgccggtacctacgtacggttcaccggtccctaaccgcccggtacccttcccgaccggtaaccttccggtcccgggttaccggtcccgtaccgaccgggtacggtaaccgggaacgggtacggtaacgtttacggtcttaacggttttacttaggttttaccgggtactttaataaccggtttaaacaaccccgtaagtaccggtaacgttaacccggtaaggtttaccggggttacggtacggggacggttacgggacggtacgccggtaaccggtactaccggtacgggcctaccgggtaccgacgggtcccgttaccgttcccggacgttccggacctttcgggttccctacccgttccctacgg

SEQ ID NO: 275053 - DNA, 816 bp, Homo sapiens
  misc_feature: GYAE6OF02HWHT4.27.23.C01.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctacctccgtgtctgggtctcctggacagtcgatcacatctcctgcactcggaacccngatgtacgttggtntacttataactttatcttggttacggtaccgtaacgacggtacccgaggctaacctcgtaccccctaaactctaattttacctttatagtattacggttactaagttaacgttcccggacccccggtaaggggttttcctaagtacttaccggtcttacgttaacgtcgggtaccttcccgtaaacgttccgtacgtaccccgtaacgtaccgggtaccccttaccccgtacgaaccctaacgttccccggttacccgggtacccttacccggaaccgttcccggtaacggggtaacccggggtacggtaacggttaccgttaaggtaacgtttaaccttttaaggttagtttaacgttaacgttaacttaaccgttaaaaccgtaacccggtacgttaacggtaaccgttccgggtttagggttcccgggttacgggggtacggggtaaccgggtaaccgttacgggtacgtaccgggtacccgtaccggttacgacgtaccgaaccggtacgcgtcccggtacccgtcgtactaccgtccgttaccctacccctaccttccctaaccgg

SEQ ID NO: 275054 - DNA, 807 bp, Homo sapiens
  misc_feature: GYAE6OF02F44YH.27.23.C01.1.454.CMB.1.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (724)..(724): a, c, t, g, unknown or other
  misc_feature (724)..(724): n is a, c, g, or t
  modified_base (731)..(731): a, c, t, g, unknown or other
  misc_feature (731)..(731): n is a, c, g, or t
tcagagcgtcgtctcacgaccggtgctcgatttagtacacgtgattagggattggggggggtctcaggaggcagccgctctcgggacgtctccaccatggcctgggctctgctattcctcaccctctcactcaggcacgacgggtcctgggcccagtctgccctgactcagcctgcctccgtgtcgtgggtcctccgtggacagtcgatcaccatcctcgtnctactcggaacccgcgatgtacggttggtctacttataacctttntcttgttaggtaccgacgacggaccctaggctacgttccgtaaccccaacgttcctagtttaccttttagtagtacttacggtacgttaagttaaaccgttccccgggaaccccccggtttagggggttttacttcgggtaaccgttccgttaccgttttacttaacgttcggtcccttaccggtaaacgttcccgttaccgtaccccttaacgaccccgggtaccccttaccccgtacggttaacccctaccggtttacccgtccccgggtaaccctttcccgaaccgggtacccgttagggaaccgggtaaccggtacgggttcgtaagttaacgtttacgttagttttaccgttagttactaattaaccgtaacctaaccgtagtaaccgtacggttaccgttgggttacggttccggagggtaaccgcgtacggtccgtaccggcgttaccgnggtaccncggacccgtaggtccctcccggtccctaccggttcccgtaaccgttccgtttacccgtacccccgtacctaacccg

SEQ ID NO: 275055 - DNA, 747 bp, Homo sapiens
  misc_feature: GYAE6OF02F73NH.27.23.C01.1.454.CMB.1.raw
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcgagggcacgagggtcctgggcccagtctgccctgactcagcctgcctcgtgtcgtgggtctccgtggacagtcgatcaccatcctctgcacgtcgggaacccngatggtacgttggtgtacttaattaactttntcgttgttacggtaccgacgacggacccgaggtcctacgtccgtaccccaaactctatttctttatgtatcgtcaacgtaacgtcccgggtaccccggttaggggtttctacgtacttccgtacttacgtaggtcgtacctaccgaagttcctacgtacccgtacgtacccggtcccttcccgtacgtaaccctcgttcccggtcccgggtcctacccgacggtccgtacgggacgggtacggacggtcgttagttaactttagttactttacggttacgttactaagttaacctaaccgtaaactaggtaacgacgttacgggtttcggggtacggttacggggacgggtacgggaacgtcgggtactaccgggtaccgttacgtacggtaccgaccggtacccgacggtcccgttccccggtaccccgttcggtaccctaccgttcccgtttaccccgttacccctaccccgtacccg

SEQ ID NO: 275056 - DNA, 704 bp, Homo sapiens
  misc_feature: GYAE6OF02GJT6Q.27.23.C01.1.454.CMB.1.raw
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (335)..(335): a, c, t, g, unknown or other
  misc_feature (335)..(335): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgacgggtcctgggcccagtctcgccctgactcagcctcgcctccgtgtctcgggtctcgtggacagtcgtatcaaccatcctctcgctacncggaaccgngatgacgttggtagtacttaattaactttntcgtgttcggtaccgacgacggaccnggacctacgtacctaccccaactcttactttctttaagngtacgttgtaacgtaagtaccggtcccggtaccccggttagggttctagtactccgttacttcgtagtccgtaccgtacgtagtcctacgaccctaccgacccgtccctaccgactaccgtacgtcccgtccgctccgacgtcgtacgacggtacggcggtatagttaatttcttagttacgttagtactaagttaacactaacgtagtacgtaacgtacgggttggtaccgtcgggtaccggacggtactacgggtcctaccggtaccggttacgtcggtaacgacgggtaccgtaccgggtcccgtaccccggttcccgtacggtaccgtttaccgcccggtttaccctcccggtaccccttaccgg

SEQ ID NO: 275057 - DNA, 842 bp, Homo sapiens
  misc_feature: GYAE6OF02GS1UM.27.23.C01.1.454.CMB.1.raw
  modified_base (142)..(142): a, c, t, g, unknown or other
  misc_feature (142)..(142): n is a, c, g, or t
  modified_base (217)..(217): a, c, t, g, unknown or other
  misc_feature (217)..(217): n is a, c, g, or t
  modified_base (295)..(295): a, c, t, g, unknown or other
  misc_feature (295)..(295): n is a, c, g, or t
  modified_base (736)..(736): a, c, t, g, unknown or other
  misc_feature (736)..(736): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgngggtcctgggcccagtctgccctgactcacgctcgcctcgtgtcgtgggtctccgtggacaggtcatccaacctnttcctcctgacctaccgtacgggaaccccgcgtaagttggtacggtttgggtacttaccttttaagtttaaccttttntacggtttggttacggtaacccgtacgtaaccgggtacccaggtaccaaccgttacccgtaaccccgtaaaacttcttaacgttttacgtttaacgtacgtacgttcgttaccgtaaggttaccgtaccccggggtacccccggtttagggggtttcctacggttaacgttccggtacctttacgtacgttccggtaccgttaccgtaacgttccgtaccgtaccgtaccgtacccggtcccttccgtaaccgtacccgtacgttcccggtaccggtccgtaccgtaaccggtcccggtaggaccgggtaacgtacgggtcctttacggttaattttacggttacgtttagttacggtaactttaacgtaaccgttaaacgaccggtagttaacgttaccgtgggtttaccggggtactcggggacgggtaacggtaccgnggtccggtaccgttacggtacctacggacccgaccgtaccggaccttcccgtcccgtccccgttcgcctttaccggtccgtttacccgtcccccgttacctaccgg

SEQ ID NO: 275058 - DNA, 700 bp, Homo sapiens
  misc_feature: GYAE6OF02I4IPC.27.23.C01.1.454.CMB.1.raw
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctccgtcactcagggcacagggtcctgggcccagtctgccctgactcagcctgcctccgtgtactgggtctccgtggaccagtcgatccaccatctcctgccacgtggaacccngatgacgttggncttatacttntctgtgtcacgacgaccagcacgtcgtaccccaatctatttcttagtgtatgtacagtaactacccggtccccgtaggggtttcacgtacgtcgtacctttactacgtcggtacgtaccttaaaggtcctacggtaccccttaaccggaaccgggtcccttaaccccggtagaaccctacgttacccggttccgggtacccttcccgacggtaccgtacgggtaacgggacggtaacgtcgtagttaactttaagttacttaggttacgttacacgttataacccaacggtcgtacgtacgtacgtttgggaccgttacgggaccgttgggaaccgtcggtacctccgggtaccgtcgttaacggtaccaaccgtacccgtaacgggccttcccggtccccgttaggtaccgtccgttccgtacggtccccctactaccccg

SEQ ID NO: 275059 - DNA, 855 bp, Homo sapiens
  misc_feature: GYAE6OF02JOK5B.27.23.C01.1.454.CMB.1.raw
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcgagggcacgtacgggtcctgggcccagtctgccctagactcagcctgcctcgtgtcgtgggtcctcgtggacagtcgactccacctatcctcctgaccacgtacggaaccccgngagtcggtacgtttgggcttactttaattaactttntcgttggttaccggtaacccgacgtaaccgggtaccccagggtacctaccgttacccggtaacccccctaaaacgttcttaacgttttccgttttaagtacggtacggtttccttaaccgtaaacgtttaaaccccggggtcccccggggttaccccgggtttaaggggttttacctcggtaaccttccggtccttttaacgtacgtccgggttaacctaacccgtttaacgttcccgtaccgtaccccggttacccgtaacccgggttcccctttaacccgacgtaaccccgtacccggtttcccggtacccggtacccgtacccgtaccgtacccgtacgggtaccgggtacggtacggtacgttacgttacgtttaacgtttaacgtttacgttacgttacgttaacgttaacaaccgttttttttttaacgacgttacgtacgttacgttacgggttcggtacgggtacggtacggtacgtacggtcgtacgtacgtacgtacggtacgacggacgtacgtccgtcccgtcccgtcgtccgtccgtccgtaccgtcccgtcccgtcccg

SEQ ID NO: 275060 - DNA, 676 bp, Homo sapiens
  misc_feature: GYAE6OF02HWORJ.27.23.C01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaacccncgatgacgttggtgcttataactttatctgttgtaccgacgacggaccaggcactgtaccccaatcatttctttatgatgtcagtatccggccctagggtttctgatcgcttctatcgctcagtctcgtccctacacggccttccctcgaccctagtccgtccgggtcctccgacgtccgtaggtaacgggaagtacggcttaggtaacttttactttagttcggttaacgtttactaacttaactaaccgtaaacccgtaggttacgtaaccgttacggtttggggttacggtttccgggcggggaacgggtacccgagggtccgtacgtacccggttcgttaacggtccgaacggtacccgaacgggtcccttacccgggccccccgtttacgggttccctacccgttcccgtttacccggtttcccccgccccgtttaccccg

SEQ ID NO: 275061 - DNA, 724 bp, Homo sapiens
  misc_feature: GYAE6OF02F6YY6.27.23.C01.1.454.CMB.1.raw
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttgtaccgacagacccaggcactcgtaccccaaactctatttctttatgtatgtctagtaactccggcccccgtaggggtttctgtacttcgtcctttcgtagttcggccttaccgaagttcctcgtacccttaaccgacccggtccccttaccctcggaaccctagttcccgtcccggggccttacccgacggtccctagggaacgggtaccggacggtccgttagtacttttaagttaacgtttaggtttaacgtttacctaagttaactaaaccaaaccgtagtacgtaccgtacggtttcggggttacggtttacggggccgggtaacgggaacccgtacggtccgttcggtaccccggttacgtacggtaccgaaccggaccccgtaacggtcccttccggtcccccgttacgggttcctaccgtttcccggttacccgtttcccccgtcccgttacccg

SEQ ID NO: 275062 - DNA, 728 bp, Homo sapiens
  misc_feature: GYAE6OF02FF8ZH.27.23.C01.1.454.CMB.1.raw
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
tcagagcgtcgtctcacgaccggtgctcgatttagtacacgtgattagggattggggggggtctcaggaggcagcgctctcgggactctccaccatggcctgggctctgctattcctcacccttcctcactcaggcacagggtcctgggcccagtctcgccctgactcagcctgcctccgtgtctgggtcctccgtggactagtcgaattccaaccatcctcctgccactcggaaccccgngatgtacgttggtncctttaataacctttntctgttacggtaccgtacgacggaccaggcacgttcgtaccccaactctactttactttatagacttcgtacaagtaaccgtccggtaccccgtaggggtttctcgacgttccgtcttacgtagttcggcttacgtagttccgaccgtccctaacgtaccggtcccttaccccgtaccgaccgtacgttcccgcccgggtcctacccgtacgccgttagacggtacggacggtctaaggttacttactagttttcgtacgttactaacttaactaacctaacgtacgttacgaacgttaccggttacgggtccggtttacgggacgggtaccggacgtacggttccgtacggtacccgttcgtaggttacccgacgtacccggtaacgtcccgtcccggtaccccgttcgttacccgtacccttccggtttaccccgttacccgtccccgttacccg

SEQ ID NO: 275063 - DNA, 705 bp, Homo sapiens
  misc_feature: GYAE6OF02IEF0F.27.23.C01.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (495)..(495): a, c, t, g, unknown or other
  misc_feature (495)..(495): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccagtctcgccctgactcagcctgcctcgtgtcgtggtctcctggacngtcgatcacntctcngcacgtcgaccgngatcgtacgttggtcgtcttaattaactttatcttggttcggaccgagaaccggaccaggcacttccgtaccccaactcttatttcttagntattgtactagtaccgtcccgggaccccgttagggtttcngtacgtcgttcttcgtacgtcgtacctaacctagtccgtaccgaccgtacgcccgtacccttcccaacggacccttcgtacccgggttcccgggtacctaccgtccggtaccggagggtaaccggtacgacggtnttaacggttaatttacgtttaggttcgttaactataactaacgtaaccaccgtagtaccgtagttacgggttaggtccgggtcgggacggacgtaacgtacggtcgaccggtacgtccggtacgtacccggcgtaacccggcggtcccgttcccggtccccgttcggttacccgtccttcccggttacccccttccccgtaccggtcccg

SEQ ID NO: 275064 - DNA, 719 bp, Homo sapiens
  misc_feature: GYAE6OF02F22N0.27.23.C01.1.454.CMB.1.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (706)..(706): a, c, t, g, unknown or other
  misc_feature (706)..(706): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacaatcgatcaccatctcctgcacgtcggaaccccgngatcggtacgttggtntacctttaataactttntcgttgttcggtaccgacgacggaccaggccactccgtaccccaactctactttctttagtagattgtacgtaagtaacgtccggaccccgtaggggtttctgacttcgtcttcgtagtcgacctcctaagtcctcgtccctacgaccgtccccttcctacgtacctacgtcccgtccggctccgacgccgtagggacgggacgacggtcgtagtactttagttagtttacgttagttactattaacgtaacctaacgtagtacgtacgttacggtttggggttaccgtcggggacgggtaacgggaacccgtagggtaccgttaccgggtacccgttaccggtaggtacccggtaaccgggaccccggttaaggtccccgttaccccggtccccggttacggtaccttcccggttccggttccccggtttccccccncccgttaccccgg

SEQ ID NO: 275065 - DNA, 816 bp, Homo sapiens
  misc_feature: GYAE6OF02HQ5G3.27.23.C01.1.454.CMB.1.raw
  modified_base (242)..(242): a, c, t, g, unknown or other
  misc_feature (242)..(242): n is a, c, g, or t
  modified_base (435)..(435): a, c, t, g, unknown or other
  misc_feature (435)..(435): n is a, c, g, or t
tcagagcgtcgtctcacgaccggtgctcgatttagtacacgtgattagggattgggggggggtctcaggaggcagcgctctcgggacgtctccaccatgcctgggctctgctattcctcaccctcctcactcagggcacagggtcctgggcccagtctgccctgactcagcctcgcctccgtgtcgtgggtcctcccgtggacagtcgatcaccattcctcctgaccacgttccggaacccnggatcgtacggttggtatctttaataacttttatcgttggttacggtaccacgtacggacccgtacggctaaccgtctaacccccgtaaattccttaattttacctttagtgtaacttgtacgaacgttaacgccccgggtccccgttagggtttctacgtctccgtcttacgtgcggtcctacgaagttccncgtacccgtaaccgccggtaccctcccggtacaccctacgttacccgtcccgggtaccacccgtaccggtccgtacggggaacggtacggtaacggtctttaacgttaacttttaacgtttaggttaacggtttaaccgttttaccaaaagttttacccgtaaaaccttacccggtaaaggttacgtaaccgtttacgggtttaacgggggttcggttaaccggggtcggggaaaccggggtcgtaaggtaccccgtacgggttcccgaaccggttttcggaacccggtaccgtaaccccggagttacccccgggtccgttcccccggtaagttaccccgtacccggtttaccctaccccgttacccctccccgtaacccg

SEQ ID NO: 275066 - DNA, 793 bp, Homo sapiens
  misc_feature: GYAE6OF02IJH0P.27.23.C01.1.454.CMB.1.raw
  modified_base (271)..(271): a, c, t, g, unknown or other
  misc_feature (271)..(271): n is a, c, g, or t
  modified_base (568)..(568): a, c, t, g, unknown or other
  misc_feature (568)..(568): n is a, c, g, or t
  modified_base (764)..(764): a, c, t, g, unknown or other
  misc_feature (764)..(764): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacgagggtcctgggcccaggtcctcgtcccctagtacctcgacggtcccttggccccttccgtaggttccttggggtcctccgtaggacctagtccgattccacctatcctcctggcctaacgtcggaacccncgtaagttcggtacgttcggtactactttaacttaaacgtttacttcgttaggtttacgggtaacccgtaaccgaccgggtaaccccaggtacccgtaccgttaccgtaaccccctaaaacttccgtacttttaccttagtacgtagttcgtcgtacggttaaaccgtcccggtacccgtagggtttcctacgtactcgtactttcgagtaccgtaccgtccgtacgttccgtactcccgtacgtaccgtccccttacctaccgaacctccggttaccgtacccgggtcctacccgnggtccgtacgggtaaccggacggtacgtcgtagttactttacgtttacttacgtttcgtacgtattaacgaacctacgtgtaactacgtcggtttacggtggtttaacggccgggtacgaccggtacggtcgtaccgtcgggtaccgtacggtacccggaacgtccgtaacgtccgtccctaccggttccgttacncccgttcgtacccgttcccaccgttcccg

SEQ ID NO: 275067 - DNA, 909 bp, Homo sapiens
  misc_feature: GYAE6OF02G742W.27.23.C01.1.454.CMB.1.raw
  modified_base (239)..(239): a, c, t, g, unknown or other
  misc_feature (239)..(239): n is a, c, g, or t
  modified_base (847)..(847): a, c, t, g, unknown or other
  misc_feature (847)..(847): n is a, c, g, or t
tcagagcgtcgtctcacgaccggtgctcgatttagtacacgtgattagggagttgggggggggtctcaggaggcagcgctcgtcgggacgtctccaccatggcctgggctctgctattcctcaccctcctcactcagggcacgagggtcctgggcccagtctgccctgactcagcctgcctccgtgtcgtgggtctccgtgacaggtcgatccacatctcctgctacgtcggaacccgngtactggtacgttggtcgtacctttaattaaccgtttattacgttcggttaccggtaccgaacgacggaacccgaggacctacgtaccggtaaccccctaacttaccttaactttacgtttagagttacgttcgttactaaacggtaaccgtaccgggtaccccggttacgggttttccgacggttacttaccggttactttacggtacgtaccgttccgtaaccgtaacggttcccgttaccgtaccccgtaaccggttaacccgtccccggttaccccttaaccgtaacccgtaaccggtttcccgggtacccgggtaccctaccgtaccggtaccccggtttaaggggaaacccgggtaaccggttaacggggtctttaaaccggtttaagtttttaagttttaacggtttttacgttaaaccggtttacccgtttaaactttaaaccgtaaaaccccgtttaaacggaccgtttaacggtaacccggtttaccggggttttacggggttacccggggttacgggggtaacccgggaccggtaacgtaccgggtaccgttaccgggtacccttaccgggtcgaaccggaaccggtacccggtacncccggttacccggtaccccgttccggaccttacgttcccgtacccgttcccgtaccctccgg

SEQ ID NO: 275068 - DNA, 858 bp, Homo sapiens
  misc_feature: GYAE6OF02INILU.27.23.C01.1.454.CMB.1.raw
  modified_base (322)..(322): a, c, t, g, unknown or other
  misc_feature (322)..(322): n is a, c, g, or t
tcagagcgtcgtctcacgaccggtgctcgatttagtacacgtgattagggagttgggggggggtctcaggagggcagcgctctcgggacgtctccaccgatggcctgggctctgctattcctcaccctcctcactcagggcacgagggtcctgggcccagtctcgccctgactcagccgtgcctcgtgtcgtgggtctcgtggaccgtagtcgatcacctactcctcctgcacgtacggacccgtcgtagtcgtacggttcggtcgttacttaagttaactttagtcggttcgggttaacggaccgtaacgaccggacccgnggtaccgtacgtcccgtaacccctaatacgttacttttccttagtacgttacgtcgtacgtaacgttaccggtccccgggtaccccggtttagggtttctacggttacctcgtttaaccttcggtagtccgtaccgtacgtaacgttcgtccgtaacccgttacgggacccttccccgtaccgtacggaccgtaccgtttcccgggtacccggttacccacggttaccggtacccggtaacggggaacgggtaccgggtagtaccggtttaagtttaacgtttaacgttttaacgttgggtttaactttaccaaacgtttaaaccgaaaccggtaccgtaggttaaccgtccggtttaagggtttcgggggtaccgtaccggggtaacgggtcgggtaaccggtagtacccgggttccggtaaacccgttcggacggttacccgaaccggtaccgaacccggttcccggttacccgtcccgaccggttaccttaccccggttcccgtaccccggtttccccttcccgtaacccggg

SEQ ID NO: 275069 - DNA, 929 bp, Homo sapiens
  misc_feature: GYAE6OF02FR6QD.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctctcactcagggcacagggtcctgggcccagtctgccctgactcagcctgcctccgtgtcgtgggtctccgtggacagtcatccaccatctcctgaccacgtcggaaaccccgcgaagtcggtacggtttgggtcgtacctttaagttaaaccttttattcttcggtttacgggtacccggtaaccgaacgggaacccgtaacgggactaccgttccgttacccccaaaaccttcctaacgttttacttttagttagtacgtcggttactaacggttaaacgtccgggaccccccgttagggggttttctcggtacgtaccgttcctttaccgtaattcggtaccttaaccgtaacgttcgtaccgtaccgtaacctaacccggtcccttacccgtacggtaacccctacgtttcccgtccccggggtaccttacccgtacggtcccgtacgggtaaccgggtaaccgggaacggttccgttagggttaaaccgttttaacgttttaaggtttacggtttaagtttaccaaacggttttaaactaaccctaaaacccgggtaacggttaccgttaaaccggttaacggttttaacgggggttcgggtttacccggggacgggggtaaaccggggtacccgtaggggtaccgtacgggttaacccggttacccgttaacggttaccggaaacccgggtacccggtaaccggtaccggttacccccggtaccccccggttacgggttacccccggttaccgtttaccccggtttcccggttaccccccgttcccgtttaacccccgg

SEQ ID NO: 275070 - DNA, 855 bp, Homo sapiens
  misc_feature: GYAE6OF02FS3TK.27.23.C01.1.454.CMB.1.raw
  modified_base (200)..(200): a, c, t, g, unknown or other
  misc_feature (200)..(200): n is a, c, g, or t
tcagagcgtcgtctcacgaccggtgctcgatttagtacacgtgattagggagttgggggggggtcgtcaggaggcagcgctcgtcgggacgtctccaccatggcctgggctctgctattcctcaccctcctcactcagggcacagggtcctgggcccaggtctgccctgactcacgcctgcctgtccccccccccccgtntgggtctccgtggacagtcgatcaccactctcctcgacacgtcggaacccgcgatgtacgttgtgtacttaattaactttactcgttggttacggtaaccgacgtaaccggacccgacggtacctaccgtccgtaacccaaacctacctactttactttagtacgtacgttcgtactacgtaacgtcccggtacccggttacgggtttcgtacgtacgttccgtccgttacgtacggtcgtaccgtaccgtaacgttccgtaccgtacccgtaccggacccggtaccccgttacccgtaccgtaacccgtcggttcccggtcccgggtacctacccgtacggtacccgtaacgggacggaacggtacgtcgttaacgttaagtttacgtttagtttacggttaacttaccgttaaagttaaccgtaaccgtaaccgttaggttaacgtaaccgttagggtttccgggtaaccggtttccggggaacggttaaccgggtaaccgtcggttaccgggttaccgttacccggttaccggttaacggaacccggtaaccggtaacccggtaaccgggtcccgttaccccggtacccccgtttacggttaccctttacccggttcccggtttccccggttacccccgtccccggttaccg

SEQ ID NO: 275071 - DNA, 840 bp, Homo sapiens
  misc_feature: GYAE6OF02GDLSM.27.23.C01.1.454.CMB.1.raw
  modified_base (244)..(244): a, c, t, g, unknown or other
  misc_feature (244)..(244): n is a, c, g, or t
  modified_base (430)..(430): a, c, t, g, unknown or other
  misc_feature (430)..(430): n is a, c, g, or t
tcagagcgtcgtctcacgaccggtgctcgatttagtacacgtgattagggattgggggggggtctcaggaggcagcgctcgtcgggacgtctccaccgatcggcctgggctctgctacttcctcaccctctcactcagggcacgagggtcctgggcccagtctgccctgactcacgctcgcctcgtgtctgggtcctcgtggactagtcgatcgactacgtctcctgacacgtacggaacccgngtaactcggtacgttggtacgttaccttaattaaccttttagtccgttaggttaccggtaaccgacggtaccggaacccgaggtacctaccgtacccgtaaccctaaattactaacttttctttaaggacgtacgttacgaccttaaaggtaacccgtccccgggtcccgttaagggggttttacncggtaacgttccgtacgttttacggtacgtcgtaacccgtcgtaacgttccggtacttaacccggtaaccgtcccggtacccttacccggtaacgtaacccgttccggtacccgggttaccgggtaccgttacccgtaccgtaccggtacgggtaacgggacggtacgggttacttaacggttattacgtttacgttaacgttacggttacctaaacttaacgtaacgtaaccttcgtaacgtaccggtacggtttacgggtacggttacgggtaccggtacggggtacgtacggtaccgtaccggttaccggttacgtaccgtacggaccggtaccgtaccggtcccgtccgtaccccggtacgtacccgttacccgtccggttaccccgttccccgtcccgtacccgg

SEQ ID NO: 275072 - DNA, 858 bp, Homo sapiens
  misc_feature: GYAE6OF02GRUO0.27.23.C01.1.454.CMB.1.raw
  modified_base (261)..(261): a, c, t, g, unknown or other
  misc_feature (261)..(261): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcacgtcggaacccgcgatgacggttggtctcttaagttaactttntagttggttacggtaccgaccgaggacccaggccacgttccgtaccccaaactctactttcttactgattcgtacgtaacgtaacgttcccgggtaccccgttaggggtttacctaggtacgttccgtcgtttcgtacgttcggtaccctacgtaaggttctaccggtaccctaaccgacccggttacccgtacccgtaacctaccgtaccgttcccgggtcccgggtaccctacccggtaccggtacccgttacgggggaaaacgggtaccgggtaacggttaaccgtttacgggttaaactttttaacggtttacttttaaccggggtttaatttaaacgttaaaccttaaacgttaacccgaaaaccgtttcgggttaaacccttaacgggttttaaccgggtttggggttaccgggtttaccggggggacggtaaaccggggtaccgtacgggttaacgtacccggttaccgttaccgggttacggttccgaacgggaacccggttaaccgggtccttaccccgggtaccccgttggtttaacccctccggtttcccggttacccccgttttccccggacccgttaaccccgg

SEQ ID NO: 275073 - DNA, 723 bp, Homo sapiens
  misc_feature: GYAE6OF02I6JGO.27.23.C01.1.454.CMB.1.raw
  modified_base (631)..(631): a, c, t, g, unknown or other
  misc_feature (631)..(631): n is a, c, g, or t
  modified_base (653)..(653): a, c, t, g, unknown or other
  misc_feature (653)..(653): n is a, c, g, or t
  modified_base (662)..(662): a, c, t, g, unknown or other
  misc_feature (662)..(662): n is a, c, g, or t
  modified_base (674)..(674): a, c, t, g, unknown or other
  misc_feature (674)..(674): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcgagggcacgagggtcctgggcccaggtctcgcctgactcacgcctgcctcgtcgtctcgggtctcgtggaccagtcgacactaaccatcgttacctgacctacgtaccggaaaccccgcgtaacgttcgggtaacggttttggggcgttaaaccgttttaaacttaaaacctttttaacgttcccgtttagggtttaaccgggtaaccccggaaccgtaaacccggggaccccgtaagggaacccgtaaccgttccggttaaaaccccccaaacttacccgttaactttcgttaaacgtacggtactacgttacgtaaacgtacccgtacccgggacccggttaagggttactagtcgtaccgtctttacggactcgtaactcaacgtctacgacgtaccgcgtacccgtccctagaccctacggtccgacgctaccacgtcgtaggacgacgtacggatacgtaacttatagttcgtagtacactaacgtaacaacgntaacgtcagttcggtagtcggnggacgcgcngtacgtcctagngctacgactagccgtaccgcgtaccgtcacgtcctacgtcccaccgtcg

SEQ ID NO: 275074 - DNA, 683 bp, Homo sapiens
  misc_feature: GYAE6OF02F6P1Y.27.23.C01.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
tcagagcgtcgtctcacgaccggtgctcgatttagtacacgtgattagggattgggggggtctcaggaggcagcgctctcgggacgtctccaccatggcctgggctctgctattcctcaccctcctcactcagggcacaggtcctgggcccagtctgccctgactcagcctgcctccgtgtctgggtctctggactagtcgatcaacntctcctgcactggacccnatgacgttgntcttataacttntctgtcgtacgacaggaccaggcactcgtacccctaaactctatttcttagtagatgtactaagtaacgtccggtcccccgtaaggggttttctcgtacttcgtacctttctacgtgtacctctaacggttctcgtaccctaacgcccggtccctccctacgaccctactcccggtaccggtctccgacgtccgtaggacggagcggtgtacgttaatttattagttggttacgttactattaaccgtaacaactaggtacgtaccgtacggtttgggttcgggtttacgggacgggttacggaaccggttaccgggtcgtaaccgggttacccggtaccggttggaacccgtaacgggacccgtaaaccgggtccttcccggtaccccgtcggtcccgttcgttacccgttcccgttacccctccccgttaccg

SEQ ID NO: 275075 - DNA, 724 bp, Homo sapiens
  misc_feature: GYAE6OF02II1F2.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctcggcccagtctgccctgactcagcctgcctccgtgtctgggtctcctggacagtcgatcaccatctctgcacgtcgaaccgctatgtacgttggtgtacttaattaactttatcttggttacggtaacccgaacggtacggacccgtacggtcctacgtaccgttaaccccccgtaaacttcctaacgttttacctttaagttaggtacgtttacggaaccttaacggttaaaccgttccccggaccccccgggtttaaggggttttccacgttacggtaccgttacttacgttacgtcggtccctaaccgtaacgtctacggtacctacgaccggtccctccgtacgtacctaccgtcgcccggtctaccgcgtaccgtaggtacgtacgagtaccgtagttaactttattagttagttacgtattacgtaaactaccgaagtagttacgaacgttaggttcggtacgtcggacggtacgacggtacgcgtacgcgttacgtacgtaccggaacaccgtacggtcctccgtacccggtctacctaccgttccctaccgttcccctaaccctccgg

SEQ ID NO: 275076 - DNA, 1006 bp, Homo sapiens
  misc_feature: GYAE6OF02G91Q1.27.23.C01.1.454.CMB.1.raw
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgactcgacgcctgtccctccgtgtccgttgggtcctcgtggaccagtccgatccgaacctatccttccgtacgccacgtaccgggaaccccgtgacgttacggtacggtttggtacgtaccgttttaaactttaaacttttcttcgtttacggtttacggtaaaccccggtaccgaaccgggtaacccctaagggaccctaacccgttacccggttaaacccccctaaaaccttccttaaactttttacgttttaacgtacggtaatttacggttccgaaaacgggtttaaccccggtccccggggtaaccccccgggttgggggtttttcctaaccgtgttttaccccgtcgttttacccgttaacgtttacgggtacccctaacccggtttaaagtttccccgttcgtaaaccccgttacccgggtaacccggttcccgtacccgtttaacccgacttaacccggtttccccgggaccgggttaccctcccggtaacggtaccccgtacggggtaacggtacccgggtacgggttacgttagtttaacgttttaacgtttacggttttacgggttaacctttaagttaacctttaactaaaacccgttacccggaaattacccggttaaccggttaacgggttttcggggtccgggtttaaccgggggtacgggtaaacccggggtaccgtaacgggacccgttaccggggtaaccccttacggggtacgtacccggtcggtaccggtaacccggttcccgtccccggtaccccgtttacccgggtccttaccccggtttacccgttccccgttaccccgttacccccgttaacccgg

SEQ ID NO: 275077 - DNA, 774 bp, Homo sapiens
  misc_feature: GYAE6OF02IHPI9.27.23.C01.1.454.CMB.1.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
tcagagcgtcgtctcacgaccggtgctcgatttagtacacgtgattagggagttgggggggggtctcaggaggcagcgctcgtcgggacgtctccaccatggctgggctctgctattcctcaccctcctcactcgagggcaacgcgggtccgtcgggcccagtctcgccctgacctcacgcctcgtcctccgtgtcgtcgggtcctccgtagactagtacgatccacctactctccngcctacgtacggaaccgnagtgtacgttcggactacttaattagttttatccgttcggttacgtaacccgaagtccggaaccgcgtctaaccgtaccgaaccctaagtcgttaacttcttagngtactntaaccgaaggttaccgtcccgggtaccgtttacgggtnacggtactcgttatactcggcgtacctaacgtgtaccggtccaccgttaccgacggtccccttaacgcgtacccgttaccgtccggggtacccgtaccgaccggtaccgtaccggtacggaaccgggtacgtacggtcgttaacgttatttaacttcgtttaagtacggttactaacgttaaccgtaacgtaataacggtcgtttaccggttaggtttacgggtacgggttaccggggaaccggtacgggtaaccgtcgggtacgttaccggtacggtacgacggttaccggaaccggaccgtacggtcctcccggtaccgttccggtaccttaccggtttaccccgtaccttcccgggtccttacccgg

SEQ ID NO: 275078 - DNA, 1112 bp, Homo sapiens
  misc_feature: GYAE6OF02HQC1B.27.23.C01.1.454.CMB.1.raw
  modified_base (129)..(129): a, c, t, g, unknown or other
  misc_feature (129)..(129): n is a, c, g, or t
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctnactcaggcacgagggtcctgggacccagtcctcgcccctgactcacgcctgcctccgtgtcgtggtcctctggacagtcgatccaccatctcctgcaccgtacggaacccngtatggacggttgtcgtatttaattaacttttancgtttaggttacggtaaccgacgaaccggtaccccgagggcctaccgttaccgtaacccccctaaaacgttcctttaattttaccgtttagtagtacgttcgaaccgtttaacggtaaacccggttccccccgggacccggttttaacgggggttttcaagtacccggttttcggacctttttcgtaacggttccggtccccttaacgggtaacgtttccgtccggaaaccccttaccggtaacccggttccccctttaccgtaacccgtaccgtaccccggttttacccgggcccgggttaaccccgtaccgtaaccgggtttcccggggtaacggtaacccggggggtaaacgtacccggggtttacgtttaaaggtttttaccgtttttaaaacgttttttaccgggttttaaagggtttaaaccgttttacccttaaaaacgggtttttaaaacccttaaaccccgggtaaaaccgtttaacgggttttaacccggggttaaaaccgttttccgggggttttttaaacccggggggtttcgggggtttaaacccggggggaacccgggggtttaaacccgggttaaccgggtaaaccccgggttcccggggttttaaaaccccggggttaaccccggggttaacccggtttaaacgggggtaaccccccgggttaaaacccgggaaccccggttaaaacccgggggttttccccccccgggtttaacccccccggtaaccccccgggtttttcccggttaaaccccgggttcccctttaacccccgggtttttcccccccgggtttacccccttaccccccccgggttaacccg

SEQ ID NO: 275079 - DNA, 840 bp, Homo sapiens
  misc_feature: GYAE6OF02HOCC1.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtcctccgtgacacggtcgatccaccatcctcctcgactacgtcggaacccgtcggatcggtacggttggtacgtctttaacgttaactttctcgttggttacggtaaccgacgaccggacccaggacctacgtaccgtaccccaaacgtctacgtttctttatgtaacgttcgtactaagttaaccgtccccggtaccccggttagggttctgtacgtcgtcttactagtcgacctcgtagtctacgacctacgaccgtccctaccgtacgaccgtacgttcccgtaccgggtcctaccgaaccggtcccgtaacggggtaacggaccggtaagggttcgttaacgtttaagttttaaccgttttaagtttacggtttaaacttacgtaaacgtttaaacgtaaacccgtaaacgtaccggttaacgtaaccggttacggttttacggggtcgggtttaccgggggaaccggggtaaccggggttaaccggtacggtcccggttaaccggttaccccgtaacgggtacgggttaacccggaacccggtaaccccggtaaccgggttcccgttaacccccggtcccccggttaaggttacccctaccggtttccccggtttacccggtcccccgttaccccgttaacccg

SEQ ID NO: 275080 - DNA, 807 bp, Homo sapiens
  misc_feature: GYAE6OF02GPTLP.27.23.C01.1.454.CMB.1.raw
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
  modified_base (685)..(685): a, c, t, g, unknown or other
  misc_feature (685)..(685): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctgggcccagtctcgccctgactcagccttgccctccgtgtcgtgggtctcctggacaggtcgatcacctgtctccgtgactacgtcggaaaccccgngtaatggtaacgttggtacgtctttaacttaactttacgtttntcggttcggtaccgacgacggaaccgacgtcgacctcgtacccgaaactactacttagtttactgtactattcgtaactaacgtcccggcccgttacgggttagtcgaacttcggtccttacgttgtcgtcctaccgtaacgtcgtccgttacccgacctaaccggtcccgttacctacgtaccggtacttcccggtacccggttaccgacccttaacggccttaccggggaaacgggtacccgggttaacgggtccttaagttaacggttttaccttaagttttaaccggggttactttaccgtaaactttacggtaaaccctaaccggtaacgttaacgtcgttaaaccggtttcgggtcggggtttaccgggaaacgggccgtaaccgggttaccgnggttaacccggtacccggttacgtcccggttaaacgccgggaaccccgttaacggttcgtcccccgtcccggttaacccggttacgtccccgttaacgtccccgttccccgtacccgtcccg

SEQ ID NO: 275081 - DNA, 885 bp, Homo sapiens
  misc_feature: GYAE6OF02I89YZ.27.23.C01.1.454.CMB.1.raw
  modified_base (263)..(263): a, c, t, g, unknown or other
  misc_feature (263)..(263): n is a, c, g, or t
  modified_base (335)..(335): a, c, t, g, unknown or other
  misc_feature (335)..(335): n is a, c, g, or t
tcagagcgtcgtctcacgaccggtgctcgatttagtacacgtgattagggagttgggggggggtctcaggaggcagcgctctcgggacgtctccaccatggcctgggctctgctattcctcaccctcctcactcgagggcacgagggtcctcgggcccagtctcgaccctgacctcgacgccctgccctccgtgtcgtgggtcctccgtggacgtacgtacgactaccgacctatcccgtcctcgaccgacgtaccggaccgngacgtcgtaccggttggtactactttaacttaacgtttctcgttacggttacggaccgacgtacggaaccgnggtaccctagttacccgtaaccctaactcttactttacgttacgtgtacgttaccgtacgttaacgtaaccgtccccgggtacccgtttaggtttccgaacgtttcgtaccttacgttacttaacggcgtacctaccgtaacgttccgtaccgtaacccgttaccgcccgttaccgacccgttacgaacccgttccggttccgacggtacccgtaccgtacgtacggttaccgggaccggtaacgtccggttacgttaaggtttacgtttacgtttaacggttccggtttaacttaacctaacgttaaaccgtaaccgtacggtttactaacggttaccgtttacggggttacccggttcgggttaaacgggacccgggtaacgggttaccgtaccgggttacgtcccgggttaaaccggccgtttacggaacccggtacccggttaacccggtacggtccccggtttaccccggttaccccccggtttaccggtacgttaaccccggggttcccccttacccggggttccccttaccccggttaaccgg

SEQ ID NO: 275082 - DNA, 750 bp, Homo sapiens
  misc_feature: GYAE6OF02HJY7M.27.23.C01.1.454.CMB.1.raw
  modified_base (252)..(252): a, c, t, g, unknown or other
  misc_feature (252)..(252): n is a, c, g, or t
  modified_base (362)..(362): a, c, t, g, unknown or other
  misc_feature (362)..(362): n is a, c, g, or t
  modified_base (464)..(464): a, c, t, g, unknown or other
  misc_feature (464)..(464): n is a, c, g, or t
tcagagcgtcgtctcacgaccggtgctcgatttagtacacgtgattagggagttggggggggggtctcaggaggcagcgctctcggggacgtctccaccatggcctgggctctgctattcctcaccctcctcactcgaggcacgagggtcctgggcccagttcctggccctgactcgagcctgccctccgtgtcgtgggtcctcctgggactacggtcgatcaccgatcctctcggacacgtaggaatccgngtatcggtaacggttggtacgtactttaataactttagtcttggttaacggccgaactacggtacccagggccactcgaaccccaaattctatttacttatcgatcgtanaagtaccgtacccggcccgttaggggttcacgtactccgtcttagtacgtcgacctaacggtataccggtctaaccctagtcccgtacctccgtacaccgtntcccgaccgacgtaccgacgtcgaggacggaccggagcgtagtactttagttaacgttagtacgttacaactaacgtaacctaacggttacgtacgtaccggttaaccgtttaggggtccgttacgggggtaccggggaacggttaccggtaacgtccggacccgttaccggttaaccgggtcggttaaaccggacccgaaacccgggttaacgcccccggttccgttcccccgggttaggttacccttaccggtttaccccgtaccggtttccccctaacccccg

SEQ ID NO: 275083 - DNA, 655 bp, Homo sapiens
  misc_feature: GYAE6OF02H5EDA.27.23.C01.1.454.CMB.1.raw
  modified_base (112)..(112): a, c, t, g, unknown or other
  misc_feature (112)..(112): n is a, c, g, or t
  modified_base (170)..(170): a, c, t, g, unknown or other
  misc_feature (170)..(170): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (213)..(214): a, c, t, g, unknown or other
  misc_feature (213)..(214): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (247)..(248): a, c, t, g, unknown or other
  misc_feature (247)..(248): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (475)..(475): a, c, t, g, unknown or other
  misc_feature (475)..(475): n is a, c, g, or t
tcagagcgtcgtctcacgaccggtgctcgatttagtacacgtgattagggattgggggggggtctcaggaggcagcgctctcgggacgtctccaccatggcctgggctctgntattcctcaccctctcatcagggcacgagggtcctgggcccagtctgccctgactcgngcctgccctcgtgtctgggtctctgacngtcatcacntctccnncatcgaccgntangtacgtgntattatactttnnttggtacgtaccgactacgaccgagccactcgtaacccctaaatctacttctttagngtntggtcagtaacctccgggtcccgtagggtttccagtctcgtnttaactagtcgtcctacgacgttcgtcacctacgtaccgtcctaccgnaccgtntcccggngtccctacgccgtacgtgggaccggacgtacggtctcgttatttattacgttagtccgtttaancgttaactcgaactattacgtagtttacgggtttggacgggtacggacggggacggttaccgacgggtcgttaccggccgtttacgacggtacgaccggtaacccgccggtcctaccccggttcccgtcggtaaccctttcccggttcccgttaacccgtccccccgtaaccgtacccgg

SEQ ID NO: 275084 - DNA, 759 bp, Homo sapiens
  misc_feature: GYAE6OF02FIP0B.27.23.C01.1.454.CMB.1.raw
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (593)..(593): a, c, t, g, unknown or other
  misc_feature (593)..(593): n is a, c, g, or t
  modified_base (648)..(648): a, c, t, g, unknown or other
  misc_feature (648)..(648): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatccaccatcctccgtcgcaccgttggaaaccccgcgtattcggacgtttgggtatacctttaataccttttatcttgtttggtaacccgagtacggaaccncggcactcgtacccctaaactcattttcctttanggtaacttgtccgtaaacgtaaccgttcccgggtaacccccgtagggggtttttacctcgggtactccgttccttaccgttagtaccggtcttaacccgttacgttacctccggtactaaccggtacccggccccttacccggaccgtaaccctccgttccccgtaccggtccctaccggaccgtccgttacgggaccggtaggacgcttacgtatttaacgttattcggtttacgacttaattactaacttaacnggtacgttacgtacttcgggttacgggtcgttacggggcgggtaacggtaaccgngggttactaccggttaccgtccggttaacggccgtaaccggacccggtgtacccgccccgtccggttacccgtacccgtccgtttacccgtttcccgtaccccccgttccg

SEQ ID NO: 275085 - DNA, 733 bp, Homo sapiens
  misc_feature: GYAE6OF02F2T61.27.23.C01.1.454.CMB.1.raw
  modified_base (199)..(199): a, c, t, g, unknown or other
  misc_feature (199)..(199): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacngtcgatccaccatctcctgcacgtcggaaccccgcgatgtacggttggtcgtactttaattaaccttttatcgttggttacggtaaccgacgtaacggaccccgtaaggccacttccgtaccccctaaacgtctacttttctttatgtatcgtactaagtaacgtcccgggccccgttagggtttcagtctccgtcttcgtagtcggactaccgtaagtcctacgtcccgtaccgccggtcccttacccgtacgtacccgtacgtcccgtccgggaccttccgacgtccgagggacggtaccgagggttctagttatttacgtttagttgtttaacgtcttaacgtaactaaccgtacgtacgttacgtacggttacgggtttgggttacggtccggggtacgggaacggtaccgtaggttccgtaccgtacccggttcgaaccgtcggtacccggtaccggtaccggccgttccccgtacccggttccgtaccgttccgtttcccgtacccgttccccgtaccccgttaccgg

SEQ ID NO: 275086 - DNA, 1020 bp, Homo sapiens
  misc_feature: GYAE6OF02HGABK.27.23.C01.1.454.CMB.1.raw
tcagagcgtcgtctcacgaccggtgctcgatttagtacacgtgattagggagttgggggggggtctcaggaggcagcgctctcgggacgtctccaccatggcctgggctctgctattcctcaccctcctcactcagggcacgagggtcctgggcccagtctgccctgacctcacgcctgcctccgtgtcgtgggtcctccgtaggacaggtcgactccgaccacttcctcctggcctacgtaccgggaaccccgcgtaagtcgtacgggtttcggtacgttacttttaaacgttaaccttttagtcctttaggggtttaccgggtaacccgtaaccggtaaccgggaccccgtacggtacctaacccgtttcccgtaaaccccccctaaaaacttccgtttaaccgtttttacgtttaacgtcggtaaacttaccggtccgtaaacgggtttaaccccgtcccccgggtaccccggtttaagggggttttcctacggttcgttcccggtttaaccgtttcgtaaccggttccggtaaccccgttacgtaaccgttccgttaccgtaaccccgtaccggtaccccgggttccctttacccggtaccggttaaccccgttaaccggtttccccggggtacccccggtttacgtaccccggttaccgtccgggtaacgggggtaaccggtacccgggtaaggtttcccgtaagtttaaccgttttgttttaaaccgtaggtttacttttaaacgtaactttaaccgggaacccttaacgtacgggttacctaagggttaccgggttttcgggggtttaccggtttaccgggggacccgggtaaaccggggtcgtaacccgggtacgttaccccgggttaacccggttaccggtaccggggtacctaacccccggggtaacgggtacccgggttccccgtaaccccgttacccccggggtttctttaacccgtccggttttacccccggtttcccccgttaacccccgtcccccgtttaaccgg

SEQ ID NO: 275087 - DNA, 773 bp, Homo sapiens
  misc_feature: GYAE6OF02GAH2V.27.23.C01.1.454.CMB.1.raw
  modified_base (763)..(763): a, c, t, g, unknown or other
  misc_feature (763)..(763): n is a, c, g, or t
tcagagcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctggcccagtctcgccctgactcagcctgcctccgtgtctgggtctcctggacagtcgatcaccattcctctgccacgtacggaaccccgcgattggacggtttggtctctttaataactttatcgttgttacggtaccgacgaccggtaaccgaggcctaccgttccgtaaccccctaaaacttctacttttaccgtttaatagtcgtacgtacgtaacgttaaccgtcccgggtacccccgttaggggttttcctagtacgttccgttactttcgtaagtccggtacctaccggtaacgttcgtacgacccgtaaaccggtcccgtcccttacccgtaccgaacctaaccgtttccgggtcccggtccttacccgaccggtccgtagggaacgggacggtacgtccggtaattaacgtttaacgtttatttacggttaacgtttactataaaccgtaccctaaacgtcggttaacgtaccgttacggtttcgggtcggttaccggggacgggtaccgacggtacggtcgtaccgacccggttcgtaacggttcgaaccggtacccgaacgggtccctacccgcccgttcggtctacccgttcgtcccgttacccncccgttaccg

SEQ ID NO: 275088 - DNA, 830 bp, Homo sapiens
  misc_feature: GYAE6OF02IEFZ5.27.23.C01.1.454.CMB.1.raw
  modified_base (247)..(247): a, c, t, g, unknown or other
  misc_feature (247)..(247): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacgagggtcctgggcccagtctgccctgactcacgcctgcctccgtgtcgtgggtctccgtggactgtcgactcacctattcctcctgcctacgtacgggaaccccggntaagtcggtacgtttggcttactttaattaacgtttacttcgttggttaccggtaccgaacgtaccggacccgtacggacctaccgttacccgtaaccccctaactcgttaagtttccgtttagtacggtagtttcgtacggttaaccggttaaccggtccccggggtaccccgggtttaggggttttccacggttaccgttaccggttacgtttacgtaggtccgtacgtaccgtaacgtccgtacgtaccgtaccgtcccgtccttaccctacggtacctaccggttccgcccggtactacccgtacgcgtacgggacggtaccgagttcctaaggttactttagttacggttgttacttaacgtaatactaaaccagtacgtacgtacgttagggttttcggggtacggcggggtaacgggtacgaccggttagggtacccttcccgggtaacccgttgtaaccgggtaccctaacggggtaccccctggggttccccctttaccccgggaaccccgggttacgttacccggttacccctttaacccggggtttcccctttacccccgacccggttccgg

SEQ ID NO: 275089 - DNA, 1073 bp, Homo sapiens
  misc_feature: GYAE6OF02F6NP6.27.23.C01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtacacgtgattagggattggggggggtctcaggaggcagcgctctcgggacgtctccaccatggcctgggctctgctattcctcaccctctcactcagggcacagggtcctggcccagtctgccctgactcacgcctgcctcgtntcgtgggtcctcgtggacacggtcgatccaacctgttcctccgtaggcctaacgtacggggaaacccccgtgtaacgttacgggtaaccgtttggggttcgtaacccgttttaaattaaaaccgtttttcgtacgtttcggttttaaccgggtaaaccgtaaccggtaaaccgggaaccccgttaacgggacctaaccgttacccggtaacccccgtaaaaaccttacccggttaacgtttaaccctttttaacggtacggttaactttaccggttaaccgtttaacggttaaaacccggttacccggggaccccccggtttaaagggggggtttttacctaacgggttaaccggttccgttaccgttttaaccgttaacggtccggttaccgtttaacccggtaaacgggttcccgttaaccggtaccccggttaaccggtaaccgtccccgtttacccgttaccggtaaccgtacgtttacccgggtcccggtaccgttaccgaaccgggttcccgtaaggacgggtaaccggtaacggtccgtttaagggttaacttaaacggtttcgtttaaacgggttacttaacccgtttaagttaaccgtaaacgtaaacccgtcggttaaccgttaaccggtacgggtttttaccggggttaaccggtttcggggaaacccgggggttacgggaaacccggtacgggtaacccgggtttaacccgggtaacccgtttacgggtaaacccggggtttaaccgcccgggggtaaaaccccggtttaaacccggtcccgggtttaaccccccggcccggtttaacccgggggttaaccctaacccggtttttaccccgtacccgggttttaccccccccgtaccgtttaacccccggg

SEQ ID NO: 275090 - DNA, 777 bp, Homo sapiens
  misc_feature: GYAE6OF02G6V8S.27.23.C01.1.454.CMB.1.raw
  modified_base (238)..(238): a, c, t, g, unknown or other
  misc_feature (238)..(238): n is a, c, g, or t
  modified_base (269)..(269): a, c, t, g, unknown or other
  misc_feature (269)..(269): n is a, c, g, or t
tcagagcgtcgtctcacgaccggtgctcgatttagtacacgtgattagggattgggggggggtctcaggaggcagcgctctcgggacgtctccaccatgcctgggctctgctattcctcaccctcctcactcagggcacagggtcctgggcccagtctgccctgactcacgcctgcctccgtgtctgggtcctccgtggacagtcgatccacatcctcctgacacgtcggaaccccgngatggtacgttggtgtaccttaataactttntcttggttacggtaccgacgacggaccaggccactccgtacccaactctactttcttatgtatcgtacaagtaacgtcccggtaccccgttagggtttcgaggtactacgttccttacgtacgttcggaccttaccgtaacgttccgtacgtaccctaccggacccggtcccctcccgtactaaccctacgtttcccgtccccgggtccctacccgtaccgtccgtaacgggaacggggaccggtacggtacttacgttaattttacgtttagttacggttaacgttactaaacgttacctaaaccgaacgtacgtaacgtaacggttaccgggttgggttcgggtaccgggaacgggtaccggtacggtacggtccggtacgtacccggtaccgttaacggtaccggaaccggtacccggtaaccggtccttacccggtaccccccggtttaggttccccgttaccgttccccggttaccccggttcccccggtaccctaaccccgg

SEQ ID NO: 275091 - DNA, 755 bp, Homo sapiens
  misc_feature: GYAE6OF02GU470.27.23.C01.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
tcagagcgtcgtctcacgaccggtgctcgatttagtacacgtgattagggattggggggggtctcaggaggcagcgctctcgggacgtctccaccatggcctgggctctgctattccgtcaccctcctcactcagggcacagggtcctgggcccaggtctgccctgactcagcctgcctccgtgtctgggtctcctggacagtcgatcaccatctcctgcactggaacccncgatgacgttggncttatacttatctgtggtaccgacaggaccaggcactcgtaccccaaactcatttctttangatgtacagttaactccggccccgtaggggtttctcgtaagtccgtacttcgttagtcggtcctaccgtaacgttccgtagtacccttaacgcccggtacccttaccccgtacgaaccctaacgtttcccggtcccggggtacttacccgacgtcccgtaggaccgggtacgtacgggtctaggtaactttaggttacgtttagttaacgttacgtattaacctaaccgtaactaggttacgtaccgttacgggtttcggggttcgttaccggggggtacgggtaaaccggggaacccgtacgggtccgttaaccgggaccccgtttaacccgggtacggtaccggaacccgggtaacccgtaaacgggtccccgttaacccgggttccccccgttaggtacccctaccggtttcccgtacccgttttacccccgaccccgttttacccg

SEQ ID NO: 275092 - DNA, 597 bp, Homo sapiens
  misc_feature: GYAE6OF02HHXEQ.27.23.C01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaacccngatgacgttggtgcttataactttatctgttggtaccgacacggacccaggcacgtcgtaccccaaactctattcttatgatgtcagtaactccggccccgtagggtttctgactcgtcttctagtcggctaccaagtctgacctacgacggtccctcctacgacctacgtccgtccgggctccgacgtcctaggacggacgacgctagtatttagttattgttagttcaattacaacaacgagtacaacgtacgttgggttcgttcgggacggagggaccgaggcgtcgaccgtccgtaggtccgacgacccaaggcctaccggccccgttacggtcctccgtccgttccgttaccccacccttccg

SEQ ID NO: 275093 - DNA, 744 bp, Homo sapiens
  misc_feature: GYAE6OF02JCDWH.27.23.C01.1.454.CMB.1.raw
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
  modified_base (491)..(491): a, c, t, g, unknown or other
  misc_feature (491)..(491): n is a, c, g, or t
tcagagcgtcgtctcacgaccggtgctcgatttagtacacgtgattagggattgggggggggtctcaggaggcagcgctctcgggacgtctccaccatggcctgggctctgctattcctcacctctcactcagggcacacgggtcctgggcccagtctgccctgactcagcctgcctcgtntctgggtctcgtgacngtcgatcncactctccgtgcctacgtcgggaaccccncgtagtcgaccggttggcgtactttaagtaaccttttagtcgttaggttcggtaaccgacacggtacccnggctacnccgtacccaatctaatttcttancgtatcgtacgacgttacgcccggtacccggtggtttcncgtacgttccgtcttcgtagtacgctactagttccncgaccccgttaacggcccggtccctccgtacggtacctacggttcccgaccggtccctaccgacggtcctagggaaccgggngtaacgggtcttaagggtttactttacgttagtttacggttacgtacttaagtaccctaacgaaccgttggtactaaccgggttaggtttcgggttaccgggtacgggcgggtaaaccgtccgggttaacgccgttaccggggttcccttagggtccgtaaccggcggtaaccgtacgggttcccgaaccccggttcccggtaacggttccctaccggggtttaccctccccgttacccgtacccgttaccgg

SEQ ID NO: 275094 - DNA, 790 bp, Homo sapiens
  misc_feature: GYAE6OF02IXCM1.27.23.C01.1.454.CMB.1.raw
  modified_base (369)..(369): a, c, t, g, unknown or other
  misc_feature (369)..(369): n is a, c, g, or t
  modified_base (764)..(764): a, c, t, g, unknown or other
  misc_feature (764)..(764): n is a, c, g, or t
tcagagcgtcgtctcacgaccggtgctcgatttagtacacgtgattagggattgggggggggtctcaggaggcagcgctctcgggacgtctccaccatggcctgggctctgctattcctcacccttcctcactcaaggacacagggtcctgggcccagtctcgccctgactcacgcctgcctccgtgtcgtggtctcctggacagtcgactcaccatctcctgcacgtacggaaccgcgtagtcgtaacgggttggtgtacgttttaacttaacttttacgttcgttacggtttcgggtaaccgaacgaaccggggaccccagggacctaacgtcccggtaacccctaaactcttacgtttactttaancgtagttcgtacgtacggtaacgttcccgggacccgttaggggtttcaggttacgtccgttccgtttaaggtcgtacgtccgttaacgtaacggttccgtacgtaccccgttacccggaacccggttcccctttcccgacgaaacccgttacgtccccgggttacccgggtcctaacccgtccgggttacgtacgggtaaccgggtacggtaaaccgtcgttaacggttacttttaacggtttagttacggttaacgttacgtaaacttaccgtaactacgtaggttacacgttacgggttacgggtccgttaacggggcgtaacgggtacgcggtacggaccgtaccggtcgtacgtccgtaacggcgtacgccgttaccgcccgtaccgttcncccgttactcccgtacctaccctcgg

SEQ ID NO: 275095 - DNA, 717 bp, Homo sapiens
  misc_feature: GYAE6OF02FL9SU.27.23.C01.1.454.CMB.1.raw
  modified_base (202)..(202): a, c, t, g, unknown or other
  misc_feature (202)..(202): n is a, c, g, or t
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagtcctgcctcgtgtcgtgggtctccgtggacngtcgatccacatcctctgcctactacgggaaccccgtgatcggtacggttgggctctttaaagtaacttttacgtcgttaggttacgggtaacccgtaacgaacgggacccgtagggcctaacgttccgttacccctaaaacgttctacttttacggtttatacgtatgtactaaggtactccggacccggttagggttctcgtacgtcgtcttacgtagtcggtacgtacgacgttcgtcgacccgtaacgtccgacccgttccgtacgaccttaccgtccgtaccggtcctaccgtcgaccgttacggacgggacaggtactattaacgttacttggtttaacgtattccaaattaccaactacggagttacgacgtacggtttgggtacggttaccgggaggtaccgaaccgtgggtacaccgtcccggttacgttacggaccgtaacggacccgtacggccgttccgacccgtcgttaccaccttcccggtacccttccaccccgtaaccg

SEQ ID NO: 275096 - DNA, 850 bp, Homo sapiens
  misc_feature: GYAE6OF02JLYTU.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctggacctcacgcctgcctccgtgtcgtgggtctccgtggactagtcgatccaccatcctcctcgcctacgtacggaacccgcgtatcggtacgttggtcgtccttaattaactttactacgttggttacggacccgtaaccgacggtaccccgtaggcctaccgtccgtaccccctaacctcctacgttttactttactacgtacgttcgtactaggtaccgtacccggtaccccggttacgggttcgtacgtcgtccgttccttacgttacgtccggtacctaccgttaacgtcgtccgtacccgtaacccgtccgggttacccctacccgttacccgtaacccgtaccgtttcccggtcccccgggtaccttcccgaccggtacccgtacgggaacgggacccggtacggttccgtacggttatttacgttttacgttacgggtttacgttctaacgttaacgttaaccgtaaccgaacgttacgaccggttttaccggtcggttttacggggtaccgggtaccggggaaccggttaaccgtacggtaacccgttcccggtacccggttaccgttaacgggtacccggtaacccggaccgttaccggtcccgttaccccggttcccccgtacggttacccgtcccgttacccgtttccccgtacccccgtccgtttaacccccgg

SEQ ID NO: 275097 - DNA, 859 bp, Homo sapiens
  misc_feature: GYAE6OF02JXCCI.27.23.C01.1.454.CMB.1.raw
tcagagcgtcgtctcacgaccggtgctcgatttagtacacgtgattagggattgggggggggtctcaggaggcagcgctctcgggacgtctccaccatggcctgggctctgctattcctcaccctctcactcgagggcacgagggtcctgggcccagtctgccctgactcagcctgcctcgtgtctggtctccgtggactagtcgactcacctatcctaccgtgacctacgtaccgggaacccgcgaagttcggtaccggtttggtcggttacctttaacgttaaacgttttacttaccgtttacggttacgggtaaccggaacgtaaccgggtaaccccgacgggtaccgtacccgttaccgtaaacccccgtaaacgttcctaaccgttttacgtttaacgtacgttaacgttccggtaacgttaacggttaaccggttccccgggtacccccgtttaggggttttccacggtacgttcccggttcgttacgttacgtacggtaccttaacgtacgttcgtaccgtaacccgtacggtaccgtcccctaccgtacgacccgtcttaccggccggtacctccggacgtacggtaggaccggtacggtcggtactagttactttagttaacgttcggttaacgttaactagttaaaccctaacgtaaaccgtacgttacggtaacgttaggttccgggtttacggtcggggtacgggtaaccggaggtaccggtacgtaccgggttaccttaccgggtaccggtaacgtaccgggacccggttacgtacccgttcccggtacccgttaaccggttccgtaaaccgttcccgtttccccggttacccctaccccgtaccg

SEQ ID NO: 275098 - DNA, 803 bp, Homo sapiens
  misc_feature: GYAE6OF02ID0YB.27.23.C01.1.454.CMB.1.raw
  modified_base (171)..(171): a, c, t, g, unknown or other
  misc_feature (171)..(171): n is a, c, g, or t
  modified_base (291)..(291): a, c, t, g, unknown or other
  misc_feature (291)..(291): n is a, c, g, or t
  modified_base (357)..(357): a, c, t, g, unknown or other
  misc_feature (357)..(357): n is a, c, g, or t
tcagagcgtcgtctcacgaccggtgctcgatttagtacacgtgattagggagttggggggggtctcaggaggcagcgctcgtcggggacgtctccaccatggccgtgggctctgctattcctcaccctcctcactcgagggcacgagggtccgtcgggcccagtccttccngactcagctgcctcgtgtcgtgggtctcgaggactaggtcctacacacctacgttccttcgtacggccaacgtccggaacccggtgtatcggtacggttggtctacgtttattaactttntcgttaggttcggactacgacggccacggccacgttcgtaaccccgtaatctatttctttagtcgnttcgtgaacgtacgtacccggccgttacggttcgtcgacttccgtagttaccgtcggtctacccgtaccgtagtccgtaccgtaccgtaacgtccgtaccgtccctaacgccctaccggtttcccggccgtttcccgaaccgttccgtaccggtagggaaccgggtacgggtaagtccggttaactttaacgtttagttacgtttaggttaccgttaagttaacgttaaccgtaaaccgtaacgtaccgtacgggttaacggttaccggttacggggttaccgggttccggggaccgggttacgggaaccgtcgggtaccggtaccggttacccgtccgtacggggtcgacccggtaacggacccgtccgttacccgtcccgggttaccgtccgttacccgtttcccgtaccccggtttacccctacccgtaccccgttaaccggg

SEQ ID NO: 275099 - DNA, 506 bp, Homo sapiens
  misc_feature: GYAE6OF01D8RFB.35.4.A04.1.454.CMB.1.raw
  modified_base (419)..(419): a, c, t, g, unknown or other
  misc_feature (419)..(419): n is a, c, g, or t
  modified_base (497)..(497): a, c, t, g, unknown or other
  misc_feature (497)..(497): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccatctgtgtcggggtctccgggggagacggttaccctctcctgcacccgcaacagtggcagcatcgccaacaactatgtgcattggtaccagcagcgcccggcagttcccccatcattgtcatttttgaagtatagtcaaaggccctctgggtccctgttcgtctctggctccatcgacagttcctcaattctgcctccctcaccatctctgactgaagctgaggacgagctgactattattgtcagtcttangatatcgacactcctgtgtcttcggcggggacaggctgaccgtcctaagcagacccaaggcctcgaccccctggtccncgtctcccg

SEQ ID NO: 275100 - DNA, 506 bp, Homo sapiens
  misc_feature: GYAE6OF01BNT18.35.4.A04.1.454.CMB.1.raw
  modified_base (346)..(346): a, c, t, g, unknown or other
  misc_feature (346)..(346): n is a, c, g, or t
  modified_base (463)..(463): a, c, t, g, unknown or other
  misc_feature (463)..(463): n is a, c, g, or t
  modified_base (497)..(497): a, c, t, g, unknown or other
  misc_feature (497)..(497): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccactctgtgtcggggtctccgggggagacggttaccctctcctgcacccgcaacagtggcagcatcgccaacactatgtgcattggtaccagcagcgcccgggcacgttcccccatcattgtcatttttgaagatagtcaaaggccctcgtgggtccctgttcgtctctggctcatcacngttcctcaattctcgccctccctcacctatctcgtgactgaacgtactgaggacggagctagacttattattgtcagttcttatgtatatcgacactcctgtgtcgtcggcggggcnggctgccgtctagcacgccagctcgcccctgtcnctcgtcccg

SEQ ID NO: 275101 - DNA, 516 bp, Homo sapiens
  misc_feature: GYAE6OF01EDK67.35.4.A04.1.454.CMB.1.raw
  modified_base (491)..(491): a, c, t, g, unknown or other
  misc_feature (491)..(491): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccagttttatgctgactcagccccactctgtgtcggagtctccggggaagacggtgaccatctcctgcacccgcagcagtggcagcattaccagcaactatgtgcagtggtaccaacagcgcccgggcacgttcccccacaccgtcatccgtgaagacactaaaaggccctctggggttcctgatcggttctctggctcatcgacacgtcctccaattctgcctccctaaccatctctggactgaagactgaggacgaggctgactactactgtcagttctttgaggcaacgatcgtggtggtgttcgggcggggacagcgtgccgtcgtaagtcacgccgaaggccncgcccctcgtcactcgtcgtccccg

SEQ ID NO: 275102 - DNA, 590 bp, Homo sapiens
  misc_feature: GYAE6OF01CWY6R.35.4.A04.1.454.CMB.1.raw
  modified_base (153)..(153): a, c, t, g, unknown or other
  misc_feature (153)..(153): n is a, c, g, or t
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (454)..(454): a, c, t, g, unknown or other
  misc_feature (454)..(454): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttangctgactcagccccatctgtgtcggggtctccggggganaccggttacctctcctgccacccgnaacagtggcagcatccgccaaacaactatgtgctattggtaaccagcagccggcccgggctacgttcccccatcattgtctatttttgaagatagtacaaacggtccctcgtcgggttcccttgtttcgttctctggtcctcatcgactacgtttcctacctaatctcgtccctcctccacctactctctaggtactgaaagtactggaaggtacgaggtctgtactattattcgtntagttcttaatgtaactataccgactaccgttctggttcggttacgttcggggacgggggaccacggtcgtcgacccgtacgtagccacggacccaacggccttcccgccccgttcggtcctcgttccgttccccg

SEQ ID NO: 275103 - DNA, 743 bp, Homo sapiens
  misc_feature: GYAE6OF01AZB3M.35.4.A04.1.454.CMB.1.raw
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcactaggttcttggcctaattttatcgctgactcacgcccatctgtcggtcgggtctcgggggagtaccggttaccctctccgtcgccacccgnaacgnggtggcagcacgtccgaccaaactaactatgtgactagttcggtaccagccacgccggcccgggacctaccggttcccccatcctaagtttcgttacttagtttttacggaaagtacgtaacgtaccgaaacggtcccttccggttccggggttcccgtttcggtttccggtttcttccgtcggtcccttaccgtacgtaccgtacgttacgtttacccgtaccgtaactttccgtccgtaccccttccctacctacctacttccgttactacggtacttacgaacgtacgtagggtaacggacggtacggtacgttagtaactttaagttagttacgtacgtacgttactttagtagttactaagtactactacgttcgttacggttcgttcgggtccggggtccggggaacgtcggtaccgtaccggttacccgtaccgtacggtaccgtaccggtacccgtaaccggtcccgtacccgtccccggttaccgccttaccgtccgtttaccccg

SEQ ID NO: 275104 - DNA, 616 bp, Homo sapiens
  misc_feature: GYAE6OF01AZPLM.35.4.A04.1.454.CMB.1.raw
  modified_base (421)..(421): a, c, t, g, unknown or other
  misc_feature (421)..(421): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccagttttatgctgactcagccccatctgtgtcggagtctccggggaagacggtgaccatctcctgcacccgcagcagtggcagcattaccagcaactatgtgcagtggtaccaacagccgccgggcacgttcccccaccaccgtcatccgtagaacgacaactaaaacggccctcgtcggggttcctgacttcggttctctggcctaccatccgacaccgtcctccaacttctcgccctccctaaccactctctggactgaacgacgtagaggacgnggactgactactacgtcgtctagttcgttttaggacgggtaccaaacggtcgttccgttgggttggggttcgggttccgggggaccggggggtaccgtaacggtcgttacggacccggttacgtaacggttccgacggacccgaacggtcctccggcccccgttcggtaccctccgttccgtccggttccccccg

SEQ ID NO: 275105 - DNA, 649 bp, Homo sapiens
  misc_feature: GYAE6OF01D5UWV.35.4.A04.1.454.CMB.1.raw
  modified_base (193)..(193): a, c, t, g, unknown or other
  misc_feature (193)..(193): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccactctgtgtcggggtctccggggganaccggttaccctctcctgccacccgcaacagtggcagcatcgccaacactatgtgcattgtaccagcagcgcccggcacgttcccccatcatttgtctattttagaagtatagtacaaacggccctcgtcgggtcctgttcgttctcgtggctccatcgactacgttcctactaacttctcgtccctccctcacctatctcgtgactgaagactggacggacgaggtctacgacttactactgtctagttcgttttaggacggtacgaacgtattcggtagggttcggggttcgggttccgggggtaccggggggacctaacgggtccgtacggtaaccccggttaccgtaaacggttaccgaaccggtaccccgtaaacgggtcccgttaccccggtcccccccgttcggttacccctaacccgtttcccgttcccgttccccccgttccccccg

SEQ ID NO: 275106 - DNA, 695 bp, Homo sapiens
  misc_feature: GYAE6OF01BTGQQ.35.4.A04.1.454.CMB.1.raw
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcacgccccactctgtgtcggggtctccgggggagaccggtttaccctctcctgccacccgcaacagtggcagcatccgaccaacaacttatgtgctattaggtaccagcacgccgcccgggcacgttcccccatcattcgtctatttttagaagtatagtacaaacggcccttacgtcgggttccctggtttcggttctcgtcggctcactcgactacgtttcctacctaactttctcgtcccctccctcacctatcctctcgactagaagacgtacggaggacgaggctagtacttaagtttattcgtctagttacttatacgtattacacgtaactacctttccggttacggttccgggtttccgggttccgggggacccggggggtacccgtaccggggtaccgttaccgggtaaccccggttacccgttaaacgggtacccgtaacccgggtaccccgtaaacgggtccccgttaccccggtacccccccggtttcgggtcccttaaccccgttcccgtttaaccccccgg

SEQ ID NO: 275107 - DNA, 582 bp, Homo sapiens
  misc_feature: GYAE6OF01ALOLC.35.4.A04.1.454.CMB.1.raw
  modified_base (216)..(216): a, c, t, g, unknown or other
  misc_feature (216)..(216): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccatctgtgtcggagtctccgggaaagacggttaccatctcctgcacccgnagcagtggcagcattacctccggcttatgtgcagtggtaccagcagcgcccgggctccttcccccaccaccgtcactccgtgaacgacactaaaacggccctacgtcggggttcctgactcggttctcgtggctccagtcgacacgtcctccaacttctcgccctccctaaccactctctggactgaagctgaggacgaggctagactactactcgtactagttcgttttggagggcaacgtactcgtggtgggtcgttcggggacggggtaccaagcgtcgtaccgtacctaaggtccgacgacccgtacgggtcctcccgtcccccgttcgggtcctaccgttccttccgttccccgtaccccc

SEQ ID NO: 275108 - DNA, 593 bp, Homo sapiens
  misc_feature: GYAE6OF01E1I7H.35.4.A04.1.454.CMB.1.raw
  modified_base (192)..(192): a, c, t, g, unknown or other
  misc_feature (192)..(192): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccatctgtgtcggggtctccggggganacggttaccctctcctgccacccgcaacagtggcagcatcgccaacactatgtgcatggtaccagcagcgcccgggcacgttcccccatcattgtcctatttttgaagtatagtcaaaaggccctacgtcggggtccctggtttcggttctctggctccatcgactacgttcctcctaacttctcgtccctcccctcacccactctctgactgaacgactgaggacgaggctagactattattgtcagttcttatgatactcgacctactccgttgttacggtcgttcggggccgggggaccgtacgggtaccgtcggacccgttccgtaaggtacctaccggacccgaacggtccctccggtaccccccgtccgggttcctaacccgtccgttacccccg

SEQ ID NO: 275109 - DNA, 809 bp, Homo sapiens
  misc_feature: GYAE6OF01DJWDY.35.4.A04.1.454.CMB.1.raw
  modified_base (153)..(153): a, c, t, g, unknown or other
  misc_feature (153)..(153): n is a, c, g, or t
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
tcagtacagatcgtcacgaccggtgctcgatttagagtagtgatcagggggtggtagctcaggaagcagagcctggagcatctccactatggcctggctccactacttctcaccctcctcgctcactgcacaggttcttgggcctaattttangctgactcagccccatctgtgtcggggtctccggggganacggttaccctctcctgccacccgnaacngtggcagcaatcgaccaaacactatgtcgactaagttcggtaaccagcaacggccggaccccgggactaacccggtttaccccccaaagttaccctcgttaggtaactttaccgtaaaaggtaaacgggtacgaacttaaccgaaaaaccggtccccgttcgggttaccgggggttcccctaggtaccgttcccgggtttactccgttcggtaccttcctaacgtttacccgaaccgtacccgtttacccctaacccgtaaactttccgccgtacccctttacccctaaaacctcgttcctacggtacggtaaccgtaggaaacgtcgttagggaacgggtacggtacggtacctaccggtaaccttacgtaaccgttgtacgttacggtttacgtttaggacgggtaacaacggtacttacggttgggtacgggttcgggtaccgggggacgggggtaccaacggtccgttacggaccccggttacgaaccggtaccgaaccgtacccggaacggtcccgttacccggaccccccgtttacgggttaccccttaccgttccgtttacccggttccccccgtaccccg

SEQ ID NO: 275110 - DNA, 556 bp, Homo sapiens
  misc_feature: GYAE6OF01C7RK2.35.4.A04.1.454.CMB.1.raw
  modified_base (153)..(153): a, c, t, g, unknown or other
  misc_feature (153)..(153): n is a, c, g, or t
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (542)..(542): a, c, t, g, unknown or other
  misc_feature (542)..(542): n is a, c, g, or t
tcagtacagatcgtcacgaccggtgctcgatttagagtagtgatcagggggtggtagctcaggaagcagagcctggagcatcgtccactatggcctgggctccactacttctcaccctcctcgctcactgccacaggttctggccaattttangctgactcagcccatctgtcgtcggggtctccggggganaccggttaccnctccgtgccacccgnaacgngtggcagtcaatccgaccaaanactatgtgcattggtaccagcagcgccggcacgttccccatcatgtctattttgagtatagtacaaggcctcgtcgggtcctgttcggttctcgtggctcatcgactcgttcnctatctcncctcctcactactctactcgactgaagactaggacggacgacggtactgtacttattattgtctaagttcttatgtatactacgactacttctgtcggttcgttacgggcgggacgtacgctggaccgtacctagttacgacgacccgttaaggcctccggtccccctggtacccncgttccgttccccg

SEQ ID NO: 275111 - DNA, 677 bp, Homo sapiens
  misc_feature: GYAE6OF01A8HZO.35.4.A04.1.454.CMB.1.raw
  modified_base (148)..(148): a, c, t, g, unknown or other
  misc_feature (148)..(148): n is a, c, g, or t
  modified_base (189)..(189): a, c, t, g, unknown or other
  misc_feature (189)..(189): n is a, c, g, or t
tcagtacagatcgtcacgaccggtgctcgatttagagtagtgatcaggggtggtagctcaggaagcagagcctggagcatctccactatggcctgggctccactacttctcaccctcctcgctcactgcacagttctggccaatttangctgactcagccccactctgtcgtcggggtctccggggganaccggttaccctctcctgccacccgcaacagtggcagcatccgccaacactatgtgcattggtaccagcagcgcccggcacgttcccccatcattgtctatttttgaagatagtcaaaggccctcgtgggtccctgttcggttctctggcctccatcgactacgttccctcctaactttcctcgtcccctcccctccaccctacttccttcgtcggactaggaacgacctaggacggacgacggctacggtaacttactttagttgttaccgtaggtttactttagtgtaacttactaccggtacctaccttcccgttaggttcgggtttaccggttccgggggtaccggggggtacccgtacggggtcccgtacgggtaccccggttaccgttaacggttacccgaacggtacccccgaaacgggtccccttaccccgggtcccccccgttacccggttccctacccgttccccgtttaccccccgg

SEQ ID NO: 275112 - DNA, 808 bp, Homo sapiens
  misc_feature: GYAE6OF01AQGVS.35.4.A04.1.454.CMB.1.raw
  modified_base (155)..(155): a, c, t, g, unknown or other
  misc_feature (155)..(155): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacgtaggttctgggcctaattttangctgactcacgcccactctggtcggtcggggtcgtccgggggagtaccggttaccctcgtcctcgccacccggcaaccgaggtcggcagccacgtccgaccaaacaacttagtgtcgactagttacggtaccagcgacggcccggcccgggactacccgttccccatcctagttcgtactttagttttacggaacgtacttacgtaccgaaccggtcccgttcggttccggggttcccttcgggtttccgttcgttcgtcggtccttaccgacgtacgaacgttccgttaccctaccgttaactttccgtcccgtccccttaccccttacctacccttactttcccgttcgtacggtaacctacgggtaaaccgtcggtacgggtaacgggacggtacggtacgttacgttaactttacgtttacgttcggtacttacggtttacttaacgtagttaacttaccgtacgttaccgtaccgtttccggttagggtttaccggggttccggggttaccgggggtaccgggggtaacccgtacgggttccggtaccggttacccggttaaccgtaacggtacccgtaccgggacccgtaccggtcccgttccccggtaccccgttccggttacccttaccgtttccccgtaccccg

SEQ ID NO: 275113 - DNA, 738 bp, Homo sapiens
  misc_feature: GYAE6OF01C29WR.35.4.A04.1.454.CMB.1.raw
  modified_base (229)..(229): a, c, t, g, unknown or other
  misc_feature (229)..(229): n is a, c, g, or t
tcagtacagatcgtcacgaccggtgctcgatttagagtagtgatcgagggggtggtagctcaggaagcagagcctggagcatctccactatggcctgggctccactacttctccaccctcctcgctcactgcacaggttcttgggcctagtttcacgctgactcacgcccatctgtgtcggagtcgtaccgggaaagtaccggttaccatcctccgtgacccgacccgnaagccgtaaggtcggacagcctaacttaccgtccggattagtgtcgctaaggttcggaaccgagcgacggccggcccggtcctacccttacccccacctaccggtacacgttccgacgaaacaacgtaaccgtaaaccggtcccgttacggtcgggtttcacggtcttcgggttcctgtacgtctccacgttaccgaccgtacgtcctaccgtaacttcctaccgtccctaccctaactcgttctacgtacgtactaagtaacgtcgttaagggaccggtaacggtacgactaacgtaccttacgttacgtcgttacgttcgtttcgttaaggacggtactaaacgtcgttcggttacgggttcggggttaccggggttaccggggaaccgggggtactacgggttaccgtaccgggtacccggttaactaccgggttacgaacccgtacccggacgtcccgtccgtaccccgttacgtcctaccgtcccgttcccgttcccctacccg

SEQ ID NO: 275114 - DNA, 649 bp, Homo sapiens
  misc_feature: GYAE6OF01DFLJU.35.4.A04.1.454.CMB.1.raw
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (371)..(371): a, c, t, g, unknown or other
  misc_feature (371)..(371): n is a, c, g, or t
  modified_base (537)..(537): a, c, t, g, unknown or other
  misc_feature (537)..(537): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccagtttcacgctgactcacgccccactctgtgtcggagtcgtccggggaagacggtgaccatctcctgccacccgnagcagtggcagcattaccngcaactatgtgcagtcggtaccaacacgcgccggcacgtccccaatactctgactactaagtaaaggtcgtatacgaaacgtccctagtcggggtaccctagacgttcggttctcgtcgggtccatacgacncgccttccgacctactccgtacgtccctaccctcgtaaccttactccttcgttcggtaacctacgtaaacgacgtaggacggacgtagggtacctacgtaactttactttaacgtcgttactacggtttacttaggtagttaagttcggtagtacttaacgggttnttcgggttcggttaccgggtcgggtaacgggaacgggtaaccctaaggtccggttacgtacccggttcggtaacggtccaccggtaccaaacgtcccgtcccgtacccccgg

SEQ ID NO: 275115 - DNA, 719 bp, Homo sapiens
  misc_feature: GYAE6OF01A2KPV.35.4.A04.1.454.CMB.1.raw
  modified_base (229)..(229): a, c, t, g, unknown or other
  misc_feature (229)..(229): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggcctaattttatgctgactcacgccccatctgtggtcggggtcgtccgggggagtaccggttaccctctccgtgccacccgcaacgnggtggcagcactcgaccaaacaactagtgtcgctacgttcggtaccagacgacggccggcccgggactaccggttacccccacgttcctaagtttcgtacttagtttttagaagtattaacgtaccgaaacggtcccgtacggttcggggtcccttgggtttccggttcttcggtcggtcctccgtaacgttccgtaccgttacgttcccttaccgtaaactttccttccgtcccccttacccctaccctaaccgtacttccgttcgtacggtaacttacggaacgtacggtacggaacggtaaccggagggtactacggtaacttagttacgttcgtactagttcttagtagtactacgtacgtacctcttcgttcggttcggttcggtccggggcgggaccgtagtccgtacggtaccgtacgtaacgtcgaccggtaccgacgcccgtcccggtccccgtacgtacccgtcgttcccgttacccccg

SEQ ID NO: 275116 - DNA, 747 bp, Homo sapiens
  misc_feature: GYAE6OF01C8Q76.35.4.A04.1.454.CMB.1.raw
  modified_base (154)..(154): a, c, t, g, unknown or other
  misc_feature (154)..(154): n is a, c, g, or t
tcagtacagatcgtcacgaccggtgctcgatttagagtagtgatcagggggtggtagctcaggaagcagagcctggagcatctccactatggcctgggctccactacttctccaccctcctcgctcactgcacaggttcttggcctaattttangctgactcacgccccactctgtggtcggggtcgtcccgggggagaccggtttaccctctccgtgccacccgcaacgagtggacagcatccgacccaaactaactatggtcgactagttcggtaccacgcacggcccggcccgggacctaccggttaccccccaatcctagtttacgtactttagttttttagaagtagtaagtaccgaaacggtccctcgttccggggtccctggttccggttctcgtggtcctccgtatccgactacgttcccgtactaacttccgtcgcccttaccctcctaccctactaccgttcgtacggtactacggaacgaccgttagggaaacggtacggacggtaccgtagttaaccgttaagtttaagtttcgtacgttacggtttacttaacgttaggtacttaaaccgttaccgtaaacccgtcgttccgttaggttcggtttaccggttccgggggtacccgggggaccgtacgggtccggtacggtaccccggttaccgtaacggttccgaccggacccgtaacggtcccgtcccgtacccccgttgtccctaccgtccgttaccccccg

SEQ ID NO: 275117 - DNA, 878 bp, Homo sapiens
  misc_feature: GYAE6OF01DH2B3.35.4.A04.1.454.CMB.1.raw
  modified_base (157)..(157): a, c, t, g, unknown or other
  misc_feature (157)..(157): n is a, c, g, or t
tcagtacagatcgtcacgaccggtgctcgatttagagtagtgatcagggggtggtagctcagggaagcagagcctggagcatctccactatggcctgggctccactacttctcaccctcctcgctcactgcacaggttcttgggacctaatttttangctgactcacgccctactcgtggtggtcggggtcggtaccggggggtacgtaccggttaccctctacctcgccgacccgacaaacgtacggtggacagccacgtaccgaccaaaactaacgttagtcggtcgacgtagttcggtaaccacggaccgaccggcccgggacccgggtacctaacccggtaccccctataccgttacgtttacgttaccgtttaagtttttaagggaacgtacgttaacggtaaccgtaaaccgggttccgttccgggttaccgggtttccccgtttcgggtttccggtttccgttcgtccgggtaccttacgtaccgttaccgttaacggttaccgtttacccctaaccgtttacttacccgtcccgtccccttaccctacccgtactaccgttcgttacggtacgggtaacgttacggtaaacggtacggtaacgggaacgggtacggaggtacccgttaacggtaaccttaaccgttcgttacggtacgttaacgttttcggttacgggaaccgggtaactaaccgttggtacgggtttggggttacggggttcggggtacgggggtaaccgggacggtacgtaccggttaccggtacccgttagaacccgtcggaacccggttacccggaccggtacccggtccccgttaccccgtacggtacccgttaccgttacccgtaccccttccccgtaaccccg

SEQ ID NO: 275118 - DNA, 516 bp, Homo sapiens
  misc_feature: GYAE6OF02IKGPM.35.4.A04.1.454.CMB.1.raw
  modified_base (467)..(467): a, c, t, g, unknown or other
  misc_feature (467)..(467): n is a, c, g, or t
  modified_base (508)..(508): a, c, t, g, unknown or other
  misc_feature (508)..(508): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccactctgtgtcggggtctccgggggagacggttaccctctcctgccacccgcaacagtggcagcatccgccaacaactatgtgcattggtaccagcagcgcccgggcagttcccccatcattgtcatttttgaagtatagtcaaaggccctctgggtccctgttcggttctctggctccatcgacagttcctcaattctgcctccctcaccatctctggctgaagactgaggacgaggctgacttattattgtcagttcttatgatatcgacactcgtgtacgtcgttcgggccggggacnggctcgaccgtctaagtcacgccagcctcgcccctcggtcnctctcccg

SEQ ID NO: 275119 - DNA, 528 bp, Homo sapiens
  misc_feature: GYAE6OF02IAZPY.35.4.A04.1.454.CMB.1.raw
  modified_base (523)..(523): a, c, t, g, unknown or other
  misc_feature (523)..(523): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaatttttatgctgactcagccccatctgtgtcggggtctccgggggagacggttaccctctcctgcacccgcaacagtggcagcatcgccaacaactatgtgcattggtaccagcagcgcccggcagttcccccatcattgtcatttttgaagatagtcaaaggccctctgggtcctgttcgttctctgctcatcgacagttcctcaattctgcctccctcactatctctggactcaagactgaggacgaggctgacttacttactgtcagttcttatgtattgggtagctaagtgttgttggttcgttcggcggacgggaccagtcgtagaccgttcctaggtcacgcccgaagaccgtcgcccccttggtaccctntcccg

SEQ ID NO: 275120 - DNA, 539 bp, Homo sapiens
  misc_feature: GYAE6OF02I1BMG.35.4.A04.1.454.CMB.1.raw
  modified_base (193)..(193): a, c, t, g, unknown or other
  misc_feature (193)..(193): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccagttttatgctgactcagccccactctgtgtcggagtctccggggaanacggtgaccatctcctgcacccgcagcagtggcagcattaccagcaactatgtgcagtaggtaccaacacgccggcccgggcacgttcccccaatactctgactactaagtaaaggtgatacaaacgaccctcgtcggggtccctgacgtcggttctcgtcggtccagtcgacagctcctcactctcgcctcctcactntctcngacnaanacgtgaggcgagctagtactatactgtctagtnttangtagtggtagactagtacgtggtacgttcgtcgggacggtacggacaggtcgtcggtaccgtacgtacggtcgaccgccaacggtaccgccgtccccg

SEQ ID NO: 275121 - DNA, 669 bp, Homo sapiens
  misc_feature: GYAE6OF02ID33C.35.4.A04.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (311)..(311): a, c, t, g, unknown or other
  misc_feature (311)..(311): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaatttttatgctgactcagccccatctgtgtcggggtctccggggganaccggttaccctctcctgccacccgnaacagtggcagcatccgaccaacactangtgcagttgtaccagcacgcgcccgggcacgttcccccatcattcgtactatttttgaaacgtntacgtgtaaacgccctgttccgggtcccttggtttccgttccttcgtcggtctcctagtccgacgtacgttccgtacctaattcctcgacccttcccgtactaccacttcctacgtcgtactagaacgtactaggacgacgtaggtacctagtaacttatttaatttcgtacgttagttccttagtacgttattaataccgtacctaacttcccgttgttcgggtttccggttccgggacccgggggtactacgggtctacgggtacccgttccgtaacgttaccgaccggtaccccgtaacggtcccgttacccggtcccccgtttccgggtaccctacccgttaccgttcccccgg

SEQ ID NO: 275122 - DNA, 653 bp, Homo sapiens
  misc_feature: GYAE6OF02G84LO.35.4.A04.1.454.CMB.1.raw
  modified_base (153)..(153): a, c, t, g, unknown or other
  misc_feature (153)..(153): n is a, c, g, or t
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (420)..(420): a, c, t, g, unknown or other
  misc_feature (420)..(420): n is a, c, g, or t
  modified_base (495)..(495): a, c, t, g, unknown or other
  misc_feature (495)..(495): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttggcctaattttancgctgactcacgccccactctgtgtcggggtctccggggganacggttaccctctcctgccacccgnaacngtggcagcactccgaccaaacactatgtgcagttcggtaccagcacggccgcccggcacgttcccccatcattgtctattttcgaagtatagtacgaaacggtccctcgtcggggtcccttaggttccggttctcgtcggtcctccgatcgactacgttccctacctaacttcctcgtccccttccctacaacccncttccgtcgtcgactagaaagtacgtacggaaggacgcgggacctagtacttagttacgtttgttacgtacgttntttatgtaacttagtaccgtaactaccttcgttacggttcgggttaccggttccggggaccgggggtacctcgggcgttacggtacccgttaaccgttacgtacgaccgaccgaacggtccgtacccgccccgttccgtacccgttactcgttccccg

SEQ ID NO: 275123 - DNA, 571 bp, Homo sapiens
  misc_feature: GYAE6OF02FSF5B.35.4.A04.1.454.CMB.1.raw
  modified_base (221)..(221): a, c, t, g, unknown or other
  misc_feature (221)..(221): n is a, c, g, or t
  modified_base (299)..(299): a, c, t, g, unknown or other
  misc_feature (299)..(299): n is a, c, g, or t
  modified_base (428)..(428): a, c, t, g, unknown or other
  misc_feature (428)..(428): n is a, c, g, or t
  modified_base (455)..(455): a, c, t, g, unknown or other
  misc_feature (455)..(455): n is a, c, g, or t
tcagtacagatcgtcacgaccggtgctcgatttagagtagtgatcagggggtggtagctcaggaagcagagcctggagcatctccactatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgctgataactatgtctcctggtaccaacaccacccaggcaaagccccccaaactcatgatttangtatgtcaagttaacgtccggtccctcgtaaggggtttctaaagtcgtcttcctctcggcttaccgaagtctggcaacgaccggtcctccctgacccatcctcgtgggtcctccgagctggaccgacgnggtctggtattactactgcacgcttanattactaccaccagcagaccacttccgtcgttcggtccggggacgggaccggaacctacggtccgttacggaccccgttccggtacggtacccgaccggtacccggaggtccccgg

SEQ ID NO: 275124 - DNA, 921 bp, Homo sapiens
  misc_feature: GYAE6OF02G1TPK.35.4.A04.1.454.CMB.1.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccactctgtgtcggggtctccggggganaccggttaccctctcctgcacccgcaaacngtggcagcatcgccaacaactatgtgcattggtaccagcagcgcccgggcacgttcccccaccaccgtcactccgtagaacgaacacgtaaaaacggccctacgtcggggttcctgacttcggttctcgtcggctccactcgacacgtcctacctaattctcgccctaccctaaccactacctcgtacggtactacggaaacgtacgttacggaacgggtacggaacgggtccgtaacggtaacccgttaaacccgttaacgttaccggttaccgttaaccggttttaccgtttttttacggggaaaccgggggtaaccgtaaaaccggggttaaacccgtttaccgggttttacgggggttttaccggggggggttttccgggggtttttacccccgggggggggttaacccgggggggggggtaaaaccccgttaaaaacccggggggtcccgtttaaacccgggggttaaacccccgggtttaacccccgggtttaaaccggggtttaacccggttaaacccgggtaaaccccccggggttaaaacgggggtcccccccggtttaccccggggttaccccccccccggtttacccggggttaacccccggttaccccggtttttacccggttttaccccccggggttttaaccccccccggtccccccgttttaccccccggtttaacccccggg

SEQ ID NO: 275125 - DNA, 794 bp, Homo sapiens
  misc_feature: GYAE6OF02HKO6P.35.4.A04.1.454.CMB.1.raw
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggcctagttttatgctgactcacgccccactctgtgtcggagtcgtccgggaagacggtgaccatctcctgccaccgcagcagtggcagctacttaaccagacaaactagtcgtgacgtagtacggtaaccaacgacggccggaccccggggtcctaaccggttaccccccaaattaccctacgttacgtaacttacgtaaagttaaacggttcgaacttaaccgaaaaccgtaccccgttacgggttaccggggtaccccgttacggtaaccggtttccgggtttacctccggtttacggggtacccttaaccgttaccggaaccgtaccggtaccttcccccgtaaccgttaaacccgttccggttacccggtacccccttaccccttaccgtaaccctttaccttccgttacccggttacggtacccgttaaacgtaaacggaaccggtacgggtaacgggaacggtaggtacccgttacgtaacgttttaacttaccgtacggtacctaacgtttcctttaagtgtaagtacggttaaggacgtaagttagtacgggttcgttcggttacggggacgggtacggaaacgtacggtcgtacggtaccgtcgtaacggcaaccgtacccaacgtacccgtccgtaaccccg

SEQ ID NO: 275126 - DNA, 595 bp, Homo sapiens
  misc_feature: GYAE6OF02H8KOE.35.4.A04.1.454.CMB.1.raw
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (407)..(407): a, c, t, g, unknown or other
  misc_feature (407)..(407): n is a, c, g, or t
tcagtacagatcgtcacgaccggtgctcgatttagagtagtgatcagggggtgggtagctcaggaagcagagcctggagcatctccactatggcctgggctccactacttctcaccctcctcgctcactgcacaggttcttgggcctagtttcacgctgactcacgccccatctgtgtcggagtcgtaccgggaaaagaccggttaccatctccgtgccaccgnacgcagnggcagcacttaccncggctatgtgcagtggacagcacgcgccggctcctccccaccaccgtcactccagacacacaaacgcctctcgggtctgtctcggttctcgtcgctcagtcgactacgtcctcaattcgcgtaccctaccctaacctatcgtctcggtactagaacgtacgnggaacggacgtaggtcgacgaactacttaacgtctactaacgtttctttagggaggtacaaacgtattccgttaggtgggtcgggttcggggaccgggggacaacggcttacggaccgttacgttacgaacgacgtaccgaacggtccgccgtccccgtcggtacctaccgtccttcgtcccctaccc

SEQ ID NO: 275127 - DNA, 545 bp, Homo sapiens
  misc_feature: GYAE6OF02JFG2E.35.4.A04.1.454.CMB.1.raw
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (396)..(396): a, c, t, g, unknown or other
  misc_feature (396)..(396): n is a, c, g, or t
  modified_base (444)..(444): a, c, t, g, unknown or other
  misc_feature (444)..(444): n is a, c, g, or t
  modified_base (476)..(476): a, c, t, g, unknown or other
  misc_feature (476)..(476): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttangctgactcagccccactctgtgtcggggtctccggggganacggttaccctctcctgcacccgnaacagtggcagcatcgccaacactatgtgcattggtaccagcagcgcccgggcacgttcccccatcattgtctatttttgaagtatagtcaaaggcccctacgtcggggtccctgttcggttctctggctccatcgacagttcctcaattctgccctccctcaccatctctgactgaanactgaggacgagctgacttattattgtcagttcttatgtatatcgacncttacctgtcgttcgttcgggccgggggtacnggtctcggaccgtcctaacgtcaacgcccgaaggtcctacgcccccgttcggtcctactccgttcccgg

SEQ ID NO: 275128 - DNA, 631 bp, Homo sapiens
  misc_feature: GYAE6OF02FRHQA.35.4.A04.1.454.CMB.1.raw
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccactctgtgtcggggtctcgggggagtaccggttaccctctcctgccacccgcaacgagtggcagcatccgccaaacaacctatggtcgctattcggtaccaagcagcccggcccgggaccaccgttccccccatccattcgtacttagtttttgaagtataagtacaaacggtcccctcgtcgggtcccttggttcggttccttgtcggtcctaccatccgactacgttccctcctaagtttcctcgtccctccctaccacctacttcctctcggactagaacgctaggacggagtacggctgtattattatgttcagttctatgtattatacgtactacgttcgttggttcggtcgttccggggaccgggggtacgacggccggtacggtacccgtcggttaaacgtccgaacgtcccggacggtcccgtacccgtccccgtcgtcctaccctccttaccccg

SEQ ID NO: 275129 - DNA, 660 bp, Homo sapiens
  misc_feature: GYAE6OF02F14T6.35.4.A04.1.454.CMB.1.raw
  modified_base (193)..(193): a, c, t, g, unknown or other
  misc_feature (193)..(193): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggccaattttatgctgactcagccccactctgtgtcggggtctccggggganacggttaccctctcctgcacccgcaacagtggcagcatccgccaaacaactatgtgcattggtaccagcagcgcccggcacgttccccatcattgtctattttgaagtatagtaccaaaggtccctcgtacgggttccctagttccggttctcgtcggtctccatcgactacgttcctccaatttctcgtcccttccctacaccctactctctcggacttaggaacgtacgtggacggacgaggcttacgacttagttaattcgtacctagttccttaatgtacttaagtccgtactaccgttccgttaggttcgggttccgttcccgggggacggggggtaaccctgggtacccgtacggtaccccggttacccgttaacggttacccgaaccggttacccggaaacggtccccgttaccggtccccccgttcgggtacccctaccgttccggtttaccccccggg

SEQ ID NO: 275130 - DNA, 795 bp, Homo sapiens
  misc_feature: GYAE6OF02IA80M.35.4.A04.1.454.CMB.1.raw
tcagtacagatcgtcacgaccggtgctcgatttagagtagtgatcgagggggtggtagctcaggaagcagagcctggagcatctccactatggcctgggctccactacttctcaccctcctcgctcactgcacaggttcttgggcctagtttcacgctgactcacgccccactctgtgtcggagtcgtaccgggaaaagtaccggttaccatcctccgtgccaccgcagcagtcggcagactacgttaccgtccggctagtgtgcctaggtcggtaaccagcacggccggccccgggccttacccttcccccaacctaccgtcctaacgtccgtagaaacgaacctaacgtaaaaccggccctgtacggggttcctagtacgttcggttctcgtggacctccactacgactaccgttccctacgtaaacgttcctacgtacccttacccgtaaaccctactttaccgttcggtaacggtaacgttacgggaaaacgttaccggtaacgggtaacgggtaaacggtacgggtaacctacggtaaaccttaaccgttaacggtttacggttacttaacgggttttcgtttaacgggaaccgggtaccgtaaaaccggtagtttaccggtcggggtttaggggtccgggtttaaccgggggggacccggggtaaacgaacggtcggtaccggtacccgttaaccgttaacggaccgtaccggtaacccgacggttacccgtacccgtccccggtaccggttacctacccggttcgttacccccggtccttaccccccg

SEQ ID NO: 275131 - DNA, 629 bp, Homo sapiens
  misc_feature: GYAE6OF02IABK6.35.4.A04.1.454.CMB.1.raw
  modified_base (152)..(152): a, c, t, g, unknown or other
  misc_feature (152)..(152): n is a, c, g, or t
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
  modified_base (526)..(526): a, c, t, g, unknown or other
  misc_feature (526)..(526): n is a, c, g, or t
tcagtacagatcgtcacgaccggtgctcgatttagagtagtgatcagggggtggtagctcaggaagcagagcctggagcatctccactatggcctgggctccactacttctcaccctctcgctcactgcacaggttctgggccaatttttangctgactcagcccactctgtgtcggggtctcggggganacggttacccnctcctgccaccgcaacngtggcagcatcgaccaacactatgtacgcattgtaccagcagcgccggcacgtccccatcattntcctattttagaagtatagtcaaacggccctcgtcgggtcctgttcgttctcgtgctccatcgactcgttcctctaacttcgtctccctaccctcacctactctcgtacgaccgtagaacgtacgtaggacggacgaggtctacgtacttaatttaacgttgttacgtacttacgttatagtacttacgtacgaacctaccgttcctcgggttcggttccggtaccggggaccgggggtaccgnggtaccgttacggtaccccgttaccgttaaacggtccaaccggtacccgaacggtcccgtacccggtcccccgtaccgggttcctacccgtttccttccccgg

SEQ ID NO: 275132 - DNA, 668 bp, Homo sapiens
  misc_feature: GYAE6OF02HB1LX.35.4.A04.1.454.CMB.1.raw
  modified_base (221)..(221): a, c, t, g, unknown or other
  misc_feature (221)..(221): n is a, c, g, or t
  modified_base (384)..(384): a, c, t, g, unknown or other
  misc_feature (384)..(384): n is a, c, g, or t
tcagtacagatcgtcacgaccggtgctcgatttagagtagtgatcagggggtggtagctcaggaagcagagcctggagcatctccactatggcctgggctccactacttctcacctctcgctcactgcacaggttcttgggccaattttagctgactcagccccactctgtcgtcggggtcgtccgggggagaccggtttaccctctccgtgcctacccgnaacagtggacagcaagtccgaccaaacaactagtcgtgcctaattcggtaccagcaagccggaccccgggctacggttccccccatactaattcggtctaatttttagaagtatagtacaaggccctagtcgggtctagttcggttctcgtcgctcatctacncgttcctacgaactttctcgtcctccctccacctacttctcttacggctagtaacgaccgtagaacggtacgacggtctagtacgttaattagtttacgtacgtagtttacttagtacgtaatcgtaccgtataacctccgtttacggttgttacggttcgggggtaccggggtaccgtagggtcctacggtacccgttaccgtaacgtaccgtaaccggtacccgtaacgggccttacccggtccccgtacccggtccttacccggttcgtttaccccccggg

SEQ ID NO: 275133 - DNA, 706 bp, Homo sapiens
  misc_feature: GYAE6OF02GD2V3.35.4.A04.1.454.CMB.1.raw
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (369)..(369): a, c, t, g, unknown or other
  misc_feature (369)..(369): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttctgggcctaattttangctgactcacgccccatctgtgtcggggtctccggggganaccggttaccctctcctgccacccgcaacnggtcggcagcatccgaccaaacacttagtgtgctagttcggtaccagcaagccggcccgggacaccgttcccccatcattgtctactttttagaagtatacgtacgaacggtccctcgtcgggtccctggttcgttctcgtgctcntcgactacgttccactacttctcgtcctccctcacctactacctcgtacgacctagaacgtcgtacggacggaacggacgtcgtacgtacttaagtttacttacgttactacgtttctttagttacgtaattacgtaaccgtacccttaccgttcccgttacggtttgggttcccggtttaccgggggtacccggggggtacccgtacggggtcccgtacccggtaaccccggtaaccgttaaccggttacccggaccggaaccccgtaacgggtacccgttacccccggtacccccggttacccggtacccttacccgttccggtttaccccccgg

SEQ ID NO: 275134 - DNA, 667 bp, Homo sapiens
  misc_feature: GYAE6OF02G3R96.35.4.A04.1.454.CMB.1.raw
  modified_base (153)..(153): a, c, t, g, unknown or other
  misc_feature (153)..(153): n is a, c, g, or t
  modified_base (529)..(529): a, c, t, g, unknown or other
  misc_feature (529)..(529): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttggcctaattttangctgactcacgccccactctgtggtcggggtccgtccgggggagaccggttaccctcctcctgccacccgcaacagtgctagctagtccgaccaaacaactagtgtacgctagttcgggtaccagcacggaccggcccgggactacccgttacccccagtcagttcgtacttagttttacgaagtactagtaaccgtaaacggtcccttacggtcgggtaccttggtttccgttcgtacgtcggtacctcgtagtcgacgtacgttacctactaacgttcgtccgtccctacccacgtacctactcgtcgtacggtactacgaagacgtcggaaggacgagtacgtacgaacttagttactcgtacgtattacgtnatatacgtccgaatctacgtgttacgggttcgtcgggacgggacctaggtcccgtagtaccgtaccgtaagtccgaaccgtaccgtaaggtcccggtccccgtaaccgtccggtaaccgtacgtacccgttaccccgg

SEQ ID NO: 275135 - DNA, 760 bp, Homo sapiens
  misc_feature: GYAE6OF02HK8LJ.35.4.A04.1.454.CMB.1.raw
  modified_base (155)..(155): a, c, t, g, unknown or other
  misc_feature (155)..(155): n is a, c, g, or t
  modified_base (200)..(200): a, c, t, g, unknown or other
  misc_feature (200)..(200): n is a, c, g, or t
  modified_base (303)..(303): a, c, t, g, unknown or other
  misc_feature (303)..(303): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactcgcacaggttcttgggcctaattttangctgactcacgccccatctggtcgtccggggtcgtccgggggganaccggtttaccctctccgtgccgtacccgcaaacgtggtcggacctaggccacttccggacccaaaccaaccttagttcggtcgtacctagtttcggtaaccnggacacggccggccccgggctaccgttaccccccatcctattcgttcttacgttttagaacgtatacgtacgaaacgtccgtcgttacgggtccttggttccggttctcgtcggtcctcctagtcgtactcgttcctactatcctccgtcccttacccgctacctattcccgttacgtacggtacttacggaacgtacgtacggtaacgggacggacggttcggtacgtacgttaacgtttacgttacgttcttaccggtttactttacgttacgttaacttacgttaccttaccgtaaccgtttcccgttgggttccggtttccgggtaccggggtacccgggggtaccgacgggtccggttaccggtacccggtaccgtaaccggtccgtaaccggtacccggtaaccgcccgttacccgtcccgttacccggtacctacccggtcccttacccg

SEQ ID NO: 275136 - DNA, 757 bp, Homo sapiens
  misc_feature: GYAE6OF02HMD5A.35.4.A04.1.454.CMB.1.raw
  modified_base (154)..(154): a, c, t, g, unknown or other
  misc_feature (154)..(154): n is a, c, g, or t
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (630)..(630): a, c, t, g, unknown or other
  misc_feature (630)..(630): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggcctagttttangctgactcacgccccatctgtgtcggagtccgtccggggaatcggtacgacctatcctccgtgaccacccgnagcctaggtcgcagccaacgttaccagacctaaatntcggtgtacgaggttacggaaccaacgacggcccggtacccgggactaaccgtttacccccgaattaccgacttacggtacttaaccgtaagttaaacgggtctaacttaacgaaaaccgtcccgttaacggttcgggggtcccctaaggtaaccgttcgggttcccttaccgggtacggggtacttaccggtacccggtaaagtccggtacctttaacccgtacctttaaaccgtccgttacgtccccctttacccgacgttaaccctaactttcccggtacggtccggtaaacccttagggtaactaacgttacgggaaacggacgtacgtcctagtaccggttatacgtcaactagtccgttaancggtagacgttacgactacggtacttcggacgttccgggtagacgggtaccgaacgaccggttacgtacgtacccgttacggtcttaacccggaacgtcccgtaagtcccgtccccgttaaccccgg

SEQ ID NO: 275137 - DNA, 792 bp, Homo sapiens
  misc_feature: GYAE6OF02JQX2C.35.4.A04.1.454.CMB.1.raw
  modified_base (155)..(155): a, c, t, g, unknown or other
  misc_feature (155)..(155): n is a, c, g, or t
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
tcagtacagatcgtcacgaccggtgctcgatttagagtagtgatcagggggtggtagctcaggaagcagagcctggagcatctccactatggcctgggctccactacttctcaccctcctcgctcactgcacaggttcttgggcctaatttttangtctgactcacgccccatctgtcggtcggggtctacgggggataccggtttaccnctcctgccaccgnaacgngtggacagtcacgtccgccaaacaactgtgtacgctagttacgtaccagacacggccgaccccgggactaccggttccccctataccgtagtttacgttacgttagtttttacgaacgtaacgttacgtacgtaaaccggtcccgttacggttccggggttaccccttggtttcccggtttccttccggttcggtcccgttccgtaaccgtaccgttacggtaccgtttaccctacccttaacgtttcccgtacgtccccttaccctcccgaacctacgttcccttacgtcggtactacgaacgtaccgtaggacggtaacggacgttcgtacgtaacgttatttacgttacgttacgtacgtttaacttacggtactaattacgttaccgtaacttccgtttcttaacgggttcgtttccgggttaaccggggtaccgggtacgggtacgttccggtaccggtaccggttacctaaacgggttcgtaacccggttcggaaacccgggtcggtaccccggttacccggtacccgttacccgttacgttccccggtttcccccgg

SEQ ID NO: 275138 - DNA, 832 bp, Homo sapiens
  misc_feature: GYAE6OF02JZ8HB.35.4.A04.1.454.CMB.1.raw
  modified_base (159)..(159): a, c, t, g, unknown or other
  misc_feature (159)..(159): n is a, c, g, or t
  modified_base (458)..(458): a, c, t, g, unknown or other
  misc_feature (458)..(458): n is a, c, g, or t
tcagtacagatcgtcacgaccggtgctcgatttagagtagtgatcagggggtggtagctcaggaagcagagcctggagcatctccatatggcctgggctccactacttctccaccctcctcgctcactgccacgtacggttcttcgggcctaattttancgctgactcacgcccctactcgtggtcggtccggggtcgtccgggggacgtaccggtttaccctcgtccgtcgacccacccgtcgaacgaggtcgggtaccacggtacaccggtaccacccgaaacgtaacctagttcggtcgacttaggttaccggaccacggtaccgacgggtccccgggccccggggtacctacccggttcccccctaattccgttacgttcgtttaccgttagttttacggaagtactacggtacgaaaccggttccgtcgttcggggtccttggtttccggttntcgtacggtccacgtacgttcgaccgttcgtacccttacctacgttccgtcgttacccctcccgtactacccgtcgttccgtcgtaaaaaacgtcgtacgtaacgtacggtacggacggtacgtacgtcgtacgtacttattacgttcgtacgttagttacttactagttacgtcgtaccgtacttaccgttcggttacggttaccggttccggggttacgggggtacccggggtaccgggtaccgggtacggttacccggttaccggttaccggttaaccggtaccggttaccggtaacccgtaccggtacccggttccccgggtaccccggttcccggtacccgttacccggtttacccgttaaccccccgg

SEQ ID NO: 275139 - DNA, 649 bp, Homo sapiens
  misc_feature: GYAE6OF02GKFRJ.35.4.A04.1.454.CMB.1.raw
  modified_base (135)..(135): a, c, t, g, unknown or other
  misc_feature (135)..(135): n is a, c, g, or t
  modified_base (156)..(156): a, c, t, g, unknown or other
  misc_feature (156)..(156): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
  modified_base (457)..(457): a, c, t, g, unknown or other
  misc_feature (457)..(457): n is a, c, g, or t
  modified_base (603)..(603): a, c, t, g, unknown or other
  misc_feature (603)..(603): n is a, c, g, or t
tcagtacagatcgtcacgaccggtgctcgatttagagtagtgatcagggggtggtagctcaggaagcagagcctggagcatctccactagtggcctgggctccactacttctcaccctcctcgctcactgcacgnggttcttcgggactaattttngcgtgtactcgacgccctatctgtggttcgggtcgtcggggggaagtccggttaccctcgttccgtgaccgcccgtaaacgngtgcagctanccgacaacgaatctgacgngtactcggtacacgcacggcgccggcgtccgtaccccntacctgttcgtacttatttcgaagacgtagtaacgaaccgtccgtacgggtcggtccgttcgttcggttacttcgtcggcctacgtactacgtctacggttaccctctaacgtccgctcccttacccnctactcgtacctntacggacgtanacggtcgtaacggcggacgtaggtaaccgtgtaccttagttacggtttacacgtttctagttacgtcctaagttaacctcgtaaactccggtacctggttcggtacggttcgggacgggtacgcgttgaccggttacctcggaacncgtaccgacgtagcccgtccggtaacctcgtactacggtcttcccg

SEQ ID NO: 275140 - DNA, 874 bp, Homo sapiens
  misc_feature: GYAE6OF02FOANI.35.4.A04.1.454.CMB.1.raw
  modified_base (272)..(272): a, c, t, g, unknown or other
  misc_feature (272)..(272): n is a, c, g, or t
tcagtacagatcgtcacgaccggtgctcgatttagagtagtgatcagggggtggtagctcaggaagcagagcctggagcatctccactatggcctgggctccactacttctcaccctcctcgcctacactgcacaggttcttgggcctaattttatgctgacctcacgccccacttcgtgtcggtcggggtccgtccgggggactaccggttaccctctcctcgccacccgcaacctaggtgccagctactccgaccaaacactagtgtacnctattcggtaccagcaacgccggcccgggtcgccgttaccccccgtatcctaacgttcgttaccgttagttttttaagaacggttattaacgtacgaaaaccggtacccttacgggttccgggttcccgttttcggtttccggttttaccgttccgttcgtaccgtacccgtacgttaccgacttaccggtttacccttacccgtaaaccgtttcctacccgtacccccgttaccccttcccaaacccttacgtcccgtttccgtaggttaacccgtaggaaacgggtaacccttaacgggaacggggtaaccgggtacggttaccgtaacggtaaaccgttttaagtttaacgttacggtttaccgttacgtttatttagttaacggtaacgtttaccgtaacttaccgttaacccgttcgttaccgggttacgggtttccggttcccgggggtaccggggaaccgggtcgggtaccgtaccgggtacccgtttaacccggtaacgtacccgggtaccctaccccgggtaaaccgtccccggttaccccggtacccccggttacccggttacccgtacccggtttacccctttacccccgg

SEQ ID NO: 275141 - DNA, 851 bp, Homo sapiens
  misc_feature: GYAE6OF02JO1EL.35.4.A04.1.454.CMB.1.raw
  modified_base (153)..(153): a, c, t, g, unknown or other
  misc_feature (153)..(153): n is a, c, g, or t
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
tcagtacagatcgtcacgaccggtgctcgatttagagtagtgatcagggggtggtagctcaggaagcagagcctggagcatctccactatggcctgggctccactacttctcaccctctcgctcactgcacaggtttctgggcctaattttangctgactcacgccccatctgtgtcggggtactccggggganaccggttacctctcctggccacccgnaacngtcggacagcatcgaccaaacactagtgcgtactacgttacggtacctagacctaggcccggacccggggactaccggtttccccccaagttccgtaatttcggttacttacgtttttacgaagtacgttacgtaactaaaccgggtccccgttaggttccgggttccccgtttggttacccggtttacgttccgtcgggtccttacccgtagttccgaacgttaccgttaccccttacttaaccgtttctcccgtttcctacccccgttacaacccctcgttaccctacgggttacgtacgtacgtaacggtaccgtacggtaacggacgtaccgggtactttacggaaccgtttagtttaacggtcttaacgtacggtttaccgttaagtaccttacgtaaccggttaccgtaaccgtacccgtttacgttaccggggtttcggttcccggggtttaaaccggggcccggggggttaacgtacccgggttaccggtaaccggttacccggttaacccgttaaaggttcccgtaacccggggtaccccgtaaaccgggttcccgtaccccgggtttacccccccgttaggtaaccccgtttacccgtaccccgttttacccccggg

SEQ ID NO: 275142 - DNA, 520 bp, Homo sapiens
  misc_feature: GYAE6OF01C4Z3O.44.3.A03.1.454.CMB.1.raw
  modified_base (211)..(211): a, c, t, g, unknown or other
  misc_feature (211)..(211): n is a, c, g, or t
tcagacagtatatacacgaccggtgctcgatttagagagcgtcacagggggagagctctggggaggaactgctcagttaggacccagacggaaccatggaagccccagcgcagcttctcttcctcctgctactctggctcccagacaccactggagaaatagtgatgacgcagtctccagccaccctgtctgtgtctccgaagggggaaanacgccaccctctcctgcagggccagtcagagtgttaccagcaacttagcctggtaccacagaaacctgggcaggctccaggctcctcatctatgaacatccacaggccacgtcggtactcccacctagtcagtgcagtgggtccggacagagttcactctcacatcagcgctgcagtctgagtatttgctagtttattactgtcagactagtaataataactcggtcctctcgtacgtttcgggacgggggacgaaggtggagagtacgaaacgtaatggtcggcgtgactacatctcgttcttcgtac

SEQ ID NO: 275143 - DNA, 541 bp, Homo sapiens
  misc_feature: GYAE6OF01B664Z.44.3.A03.1.454.CMB.1.raw
  modified_base (535)..(535): a, c, t, g, unknown or other
  misc_feature (535)..(535): n is a, c, g, or t
tcagacagtatatacacgaccggtgctcgatttagagagcgtcacagggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccgggccgagcccccaaagtcctcttttacgacgtcctttcgcgggcttcggcagtccctggccgtttttcggcctccagttctgaccacgcggcctccctgaccatcaccaaactccggcctgagatgaggctgactacttttgttgtgcatatttcgattcactcaatatgtcttcggaagtggacccgcgtcagcgtcctgcgtcacgcccaggcccaaccccactcgtcactctgttcccgccctcctctactatactgtctgngccggg

SEQ ID NO: 275144 - DNA, 525 bp, Homo sapiens
  misc_feature: GYAE6OF01D77QV.44.3.A03.1.454.CMB.1.raw
  modified_base (207)..(207): a, c, t, g, unknown or other
  misc_feature (207)..(207): n is a, c, g, or t
  modified_base (409)..(409): a, c, t, g, unknown or other
  misc_feature (409)..(409): n is a, c, g, or t
tcagacagtatatacacgaccggtgctcgatttagagagcgtcacaggggagagctctggggaggaactgctcagttaggacccagacggaaccatggaagccccagcgcagcttctcttcctcctgctactctggctcccagacaccactggagaaatagtgatgacgcagtctccagcccaccctgtctctgtctccaggggaanagccaccctctcctgcagggccagtcagagtgttggcagcagcgtagcctggtccagcagaacctggccagcctccaggcctcctcatctataccacactcccaccgaggccactggtactcccagccaagacttcgagtggcacgtgggtctgggacagtagttcactctcactatcagcacgcctgctagtctagaagtnttttgactaactttattactgacctaatagttaataagtacgtttattacctgtagttagtttgaccggtagggtacaggtctagggagtaacgtacgaaacgtactggtgctacg

SEQ ID NO: 275145 - DNA, 564 bp, Homo sapiens
  misc_feature: GYAE6OF01COXH9.44.3.A03.1.454.CMB.1.raw
  modified_base (208)..(208): a, c, t, g, unknown or other
  misc_feature (208)..(208): n is a, c, g, or t
tcagacagtatatacacgaccggtgctcgatttagagagcgtcacaggggagagctctggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaanagcccaccctctcctgcagggccagtcagagtgttggcagcagcgtagcctggttccagcagaacctggccagactcccgagctcctcatctataccacactcccaccaggccactggtactcccgagccagacttcagtcggctacgtgggtctggggactacggagtttcacttcctcacctatcagcacgcctgcagtctagaagttattttcgacttagttttacttacgtgtactagtactaggttattaggtgtaccgttcggtcccttccgttccgtaccgttttcccgggcccgttacgggaccctacgtagttccgtactttaccgaaacgtaccttggtcggtacg

SEQ ID NO: 275146 - DNA, 622 bp, Homo sapiens
  misc_feature: GYAE6OF01CNX1M.44.3.A03.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
tcagacagtatatacacgaccggtgctcgatttagagagcgtcacaggggagagctctggggaggaactgctcagttaggacccagacggaaccatggaagcccagcgcagcttctcttcctcctgctactctggcctcccagacaccactggagaaatagtgatgacgcagtctccagccaccctgtctctgtctccgaaggggaancgccaccctctcctgcgagggccagtcagagtgttggcagcagcgtagcctggttccagcaagaacctggccagacncccgagcctcctcatctataccacactcccaccgacgggccacgtggtactcccagcccagacttcgagtggcctacggtgggtctaggggactagacgttcaccttcctaccacctatccgacggccggaccgtaacgaccggtaccggtaaagttacgttttacgactttaagtttatttacgtacgtactaaccgtaccggtacgtaccgtacgtacggtaccgttaacggttacgttaggtttcgggaccgtaacggggtaaccgtaaggtcgtaggacggtaccgtaaccgtaaaacggtacgttacggtacggtacgtcgacgaccgtacg

SEQ ID NO: 275147 - DNA, 506 bp, Homo sapiens
  misc_feature: GYAE6OF01CKC2K.44.3.A03.1.454.CMB.1.raw
  modified_base (449)..(449): a, c, t, g, unknown or other
  misc_feature (449)..(449): n is a, c, g, or t
tcagacagtatatacacgaccggtgctcgatttagagagcgtcacaggggagagctctggggaggaactgctcagttaggacccagacggaaccatggaagccccagcgcagcttctcttcctcctgctactctggctcccagacaccactggagaaatagtgatgacacaatctccagccaccctgtctttgtctccgggggaacagccaccctctcttgcagggccgccagactgttgacgacgacttagcctggtaccaacagaagcctggccaggctcccagactcctcatctatgatacttctagtaggcctctggcatcccagcccgcttcagtcgcagtggttctgggacagacttcactctcaccatccaccagcctagacgcctagaagtattttgactagtttattactgtacctacaccgtaagagtcgacctcaatnttctacttcgcctaggaccaagtgatagtcaacgtactgtgctcgcacatctgtctc

SEQ ID NO: 275148 - DNA, 782 bp, Homo sapiens
  misc_feature: GYAE6OF01B0MKW.44.3.A03.1.454.CMB.1.raw
tcagacagtatatacacgaccggtgctcgatttagagagcgtcacgagggggggatctcaggaggcagcactctcgggacgtctccaccatggcctgggctctactcctctcagcctcctcactcagggcacgagggtcctggggactgtcctacctgactcacgcccgcctcagtcggtccgggactccgtggtcagtcggtcacctatcttctcgttctcagcgactaacttcacgttcggtaccctttaaagtctactatcatcggggggggtactacgtacggtccggtacccggaccgaccgtacccgtaacgttccttaccgtttaccgtaccgttccgttccggtccggtcgttccggtaccgtaccgttccgttcggttccgttttccgtccgtaccgtacgttccgtaccgtacccgtaccggtccggtcccgtcccgtaccgtaacctactacctaacccgtaacccgtccggtaccgtacggtacgtacgtacggtacggtacgttacgttacgtttacgtttacgttcgtacgtacgttacgtttacgttacgtacttactacgttaactaacttacgttacgttacggttacggtaacggttaccgggtacccgtcgtaccgtaccggtccgtaccgtaccgtaccgtaccgaccgacccgaacccgtaaccctacccgtaccgtaccgtaccgtaccgttacccttacccgttccccttacccttaccttaccgttaccttacgttaccgttcgttcggtcggtacgg

SEQ ID NO: 275149 - DNA, 571 bp, Homo sapiens
  misc_feature: GYAE6OF01BJN2P.44.3.A03.1.454.CMB.1.raw
  modified_base (208)..(208): a, c, t, g, unknown or other
  misc_feature (208)..(208): n is a, c, g, or t
  modified_base (567)..(567): a, c, t, g, unknown or other
  misc_feature (567)..(567): n is a, c, g, or t
tcagacagtatatacacgaccggtgctcgatttagagagcgtcacaggggagagctctggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaanagcccaccctctcctgcagggccagtcagagtgtagaactctagcctggtatcaacagacacctggccaggcctccacggcctcctcatctatggatgactactaccgaagtacggggccgacggggcacgtcccgacggcccgtaagggttcaaggtcggacaggttcggggtctaggacgacagtaccttcgactcctcaccatcacgcgctagacgaccgagtatttgtacttagtttattactgtcagctaagtaagtaatacgttcgtccttcgtccgttacggttcgggaccgggggtaccgtaagggtcggtaagacgtacgaaacgtagttcggtcgcgtacgacaccgtnttcg

SEQ ID NO: 275150 - DNA, 618 bp, Homo sapiens
  misc_feature: GYAE6OF01CBP6Z.44.3.A03.1.454.CMB.1.raw
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (454)..(454): a, c, t, g, unknown or other
  misc_feature (454)..(454): n is a, c, g, or t
tcagacagtatatacacgaccggtgctcgatttagagagcgtcacagggggagagctctgggggaggaactgctcagttaggacccagacggaaccatggaagccccagcgcagcttctcttcctcctgctactctggctcccagacaccactggagaaatagtgatgacgcagtctcagcccaccctgtctctgtcctccgaggggaaancgccaccctctcctgcgaggccagtcagngtgtggcngcagcgtagcctggtccagcagaacctcggaccagcctcccgaggcctcctcactctactaccacactcccaccgaggccctacgtcggtacctcccagcccaggtacttcgaggtcggactacggttgggtctaggggaactaggtacgttccaccgttctaccacctatccgagcacgccgtagcctagtcgtagtaacgtttntttcgacgtttaagttttacttaccgttagtaccgtagtacgtaagttacgttaggtacgtacgttcggtcccttaccgtttaccgtccggtttcccggacccgttacgggtacccacggttacgtaccgtaactttaaccgaaacggttcgtggttcgtaccg

SEQ ID NO: 275151 - DNA, 618 bp, Homo sapiens
  misc_feature: GYAE6OF01BP5BT.44.3.A03.1.454.CMB.1.raw
  modified_base (219)..(219): a, c, t, g, unknown or other
  misc_feature (219)..(219): n is a, c, g, or t
  modified_base (278)..(278): a, c, t, g, unknown or other
  misc_feature (278)..(278): n is a, c, g, or t
tcagacagtatatacacgaccggtgctcgatttagagagcgtcacagggggggggtctcaggaggcagcgctctcgggacgtctccaccatggcctgggctctgctgctcctcactctcctcacccaggacacagggtcctgggcccagtctgccctgactcagcctgcctcgtgtctgggtcgcctggacagtcggtcaccatctcctgcactggacnccagcggtaatattcttagtcttaacttgtctcctggtatcaacatcatcaggtaaacnccccaaatcatcatctatgaggctagtaagacgccctagtagggtttactaatcgtcttcactcgacctacgaacgtccggacaaccgacggccctaccctagaactaactctacgtcgggcctacgaggtctaggaagggacgaggtctagtaatttattagtttgttacgtctactaagtattcggttaccgtcgtactaagtccttaactttagtcgttaccgttacgggaaaggttccgggaaacctaaagggtcctaacccggtcgtaacgggtaccacggaccccgaaaggaccccctaaaccccgattacggtaccaccgtttcttaccccgg

SEQ ID NO: 275152 - DNA, 525 bp, Homo sapiens
  misc_feature: GYAE6OF01EQ9V8.44.3.A03.1.454.CMB.1.raw
  modified_base (341)..(341): a, c, t, g, unknown or other
  misc_feature (341)..(341): n is a, c, g, or t
  modified_base (391)..(391): a, c, t, g, unknown or other
  misc_feature (391)..(391): n is a, c, g, or t
  modified_base (521)..(521): a, c, t, g, unknown or other
  misc_feature (521)..(521): n is a, c, g, or t
tcagacagtatatacacgaccggtgctcgatttagagagcgtcacaggggagagctctggggaggaactgctcagttaggacccagacggaaccatggaagcccagcgcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctccagactcctcatctatgattacttcgtaggtacgggcctcgtggcatccccagtccccncttcagtggcaggtgggtctggggacagacttcactctcaccatccaccngcctagagcctgaagtattttgctagtttattactgttctactaccgtaagtaagtcgactctaatattctactttcggcctggacaaggtgatatacaaagtacgtgtcggctgacactatctgtcttnatcc

SEQ ID NO: 275153 - DNA, 617 bp, Homo sapiens
  misc_feature: GYAE6OF01A6QGS.44.3.A03.1.454.CMB.1.raw
tcagacagtatatacacgaccggtgctcgatttagagagcgtcacaggggggggtctcaggaggcagcactctcgggacgtctccaaccatggcctgggctctactcctcctcagccctcctcactcagggcacagggtcctggggactgtctaccctgactcagccgccctcagtgtccgggactcctggtcagtcggtcaccatcttctgttcttccagcgactaattccactggccctttaaagtctctatcatggtacgcagtggtcccgggccgacgcccccaaagtcctcttttacgacgtccttcgcgggtctcggcagtcctggtccgttttcggcctcagttctcgccacgcggccctcctcgaccatccaaccaaaccgtcccggctgaggctggacggctacgtacttacgttttgttgtgctattactttcgtattctactacaaatgttcgtcgttacggtaaggtcgggacccgtcgtcgacggtacctccgtacgtcgtacgacgtacccgaacggacccaaccccgtactcgtacctacgttccgttccgttcccccgtcccttccctactaccttactacttgtccgtggacggtccggg

SEQ ID NO: 275154 - DNA, 638 bp, Homo sapiens
  misc_feature: GYAE6OF01BLWQK.44.3.A03.1.454.CMB.1.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
tcagacagtatatacacgaccggtgctcgatttagagagcgtcacaggggagagctcgtggggaggaactgctcagttaggacccagacggaaccatggaacgccccagcgcagcgttctcttcctcctgcgtactctggcctcccagacaccactggagaatagtgatgacgcagtctccagccaccctgtctctgtctaccgaaggggaacncgccacccgtctcngcgacgggccagtcagtagtgttggacagcagcgtagcctaggttccagcagaacctggaccagacctccgaggcctccgtacacttacacctaccactactacccaacgacggtaccctagtacgtacctcccgagccctaagtacttcgaggtacgactacggtcgggtactagggactagtacgttaccacctacctaccgtactacgtcgacgccgacgtcccgtagcgtaggtacgtagtaactttacgtttcgaacgtttacgtttacgtacgtgtaaccgagtacttagtacttacgtacgacgtccgtacccttaccggttacctaccggtttcccggtaccgtaccggaccttcgtacgttacccgttaaccgttaacgaaaccggttcgtggtcgtaccg

SEQ ID NO: 275155 - DNA, 736 bp, Homo sapiens
  misc_feature: GYAE6OF01BOFRQ.44.3.A03.1.454.CMB.1.raw
  modified_base (220)..(220): a, c, t, g, unknown or other
  misc_feature (220)..(220): n is a, c, g, or t
tcagacagtatatacacgaccggtgctcgatttagagagcgtcacaggggagagctctgggggaggaactgctcagttaggacccagacggaaccatggaagccccagcgcagcttctcttcctcctgctactctggcctcccagacaccactaggaagaaatagtgatgacgcagtctaccagccctacctgtctctcgtcgtaccggaaggggaaacncgaccctacccgtctccgtagccgacgggtaccaggtacgaggtaggttggttacggacacggacgacggtcggtacggtccgttacggttaccgaacgtacgaaacgtaaccgtcgggacccgaacgacccgtcccgacggtcccttaccgtactacttacctaacctaccaaccacctacccgaaccgtacggacctacgtacgtaccaccacgtaccagtactacgagtacggactacggtcggtcgtacggactacgtaccgttacgacctaccgtacctaacctacgtacgacgacgtacgcctacggccgtacgttacgtaaggttaacttaggtttcgttaagtttacgttttacgtacgttacgtaccgtaagtacgttaacggtttagtacggttacgtaccgttccgttaccgttccgtttaacccgtcggttcccggtacccggtacggacccgttacgtacgttacgttaaccgtaacgtaaccggttcggtggtccgtaccgg

SEQ ID NO: 275156 - DNA, 713 bp, Homo sapiens
  misc_feature: GYAE6OF01B53QV.44.3.A03.1.454.CMB.1.raw
  modified_base (210)..(210): a, c, t, g, unknown or other
  misc_feature (210)..(210): n is a, c, g, or t
  modified_base (321)..(321): a, c, t, g, unknown or other
  misc_feature (321)..(321): n is a, c, g, or t
tcagacagtatatacacgaccggtgctcgatttagagagcgtcacaggggagagctctggggaggaactgctcagttaggacccagacggaaccatggaacgccccagcgcagcttctcttcctctgcttactctggcctcccagactaccatggaagaaatagtgatgacgcggtctccagccacctgtctgtgtctacgaggggaaancgccacctctcctgcgacggccagtcagtagtgtagcagtactaacttcgcctacgtaaccagaccaagtaaactcgtaggaccgtacgcctacccgacggtcctccctanatcgtagttggcacactacccgaaccgacgggcctaacgtcggtaacctacccgacgaccgtaggttaccgaggtcgggaccgtgggttacgggtcgtaaggggtacaacggttaacggttcctaacttacccgaccgtaacctacgtaccgaacgtaccgtaaccgtcccgttagaaccgttacgggttaacctaaggttaaacggtttcttttacgggaaacttttaagtttttaaccgttagtacgtttaacgaagtacggttaaatttaagaaacgttccggtacgttccggttaccccttaccggtaccggaaccgtaaacggtacgtaacggacgttaaggaaaccgttaaacgtaaacgttaggcggttagacctcgactaaccg

SEQ ID NO: 275157 - DNA, 681 bp, Homo sapiens
  misc_feature: GYAE6OF01BZ213.44.3.A03.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
tcagacagtatatacacgaccggtgctcgatttagagagcgtcacagggggagagctctggggaggaactgctcagttaggacccagacggaaccatggaagccccagcgcagcttctcttcctctgctactctggctcccagacaccactggagaaatagtgatgacgcagtctccacgcccacctgtctctcgtctccgaggggaacncgccaccctctcctgcgacggccagtcagngtgtgcagcagcgtagccgttgggttaccagtaccaacgtaaacccgtcggacccgaacggtccctacccgaacggtcccttccctacgtaacttcgttacgtcgggtcacctacgtcccgaccgacggcctacgttcggtaactcccgaagtccgtaaggttcgaggtcggtacgtaggttcggggtcgtaacggggactacggttacgttccgtccttactacccaccgtactcgaacgtccgacgtcccgtgcctacggttcgttagtaacgtttgtttgtacttttagttttactacgttcgtacgagttcgttaagtttaacgtacgtcgtaccgttcggtaccctttccgtaaccgttccgtttccgggacccgtacgggtaccttaacggtcgttaccgttaacttaacggaacccgttacgtggtaacgtccg

SEQ ID NO: 275158 - DNA, 792 bp, Homo sapiens
  misc_feature: GYAE6OF01CC5WS.44.3.A03.1.454.CMB.1.raw
tcagacagtatatacacgaccggtgctcgatttagagagcgtcacaggggagagctcgtggggaggaactgctcagttaggacccagacggaaccatggaacgccccagcgcagcttctcttcctcctgctactctggcctccagacttcccgaccggacgtaaattgtgttgacacaactcctccacgccctacccgttgttccttttcgtccgtccggaaggggaaacgacgcccctaccctctccgtgccgacggccacgtcgaggtagttacggttaacggtaacttacgttacgccgttaggtactacgaacacgtacctaccgtcggacccgacggtccctacccgacgtacctacccgtactacttcgtattacgtacttaccgttacggtaacggtacgggtcccttcggtcggacctacccgtaccccgtaccggtcccgttacgttacgtacggtcggtacgtacgggttcgggtacgtacgggactacggttaccttaccgtacctcctaccgacctaccgtacccgaccgtacgtaccgtacggtaccgtaccgttagtaacgttagttttacgacgtttaacgttttacctcgttacttacgtaacctacggtaagtacgttccgtaaccttacgtaactttccgttaccgttaccggttacccggacccgttaacgggaacccgttaaggtaccgtaaagtaaccgtaaaccgtaacggtacgtttcgggaccgtacgtacccgtacctacctacgttccgttccgttcgttaccccg

SEQ ID NO: 275159 - DNA, 806 bp, Homo sapiens
  misc_feature: GYAE6OF01AFMJW.44.3.A03.1.454.CMB.1.raw
tcagacagtatatacacgaccggtgctcgatttagagagcgtcacaggggagagctctggggaggaactgctcagttaggacccagacggaaccatggaagccccagcgcagcttctcttcctcctgctactctggctcccagacaccactggagaaatagtgatcgacgcagtctccagcccaccgtgtctctgtcctccgaaggggaacacgccctaccctctcctggccagggaccagtccgagtacggttggttggacctaggcgacggtacggtacggtcccgttcggttaccacggtaccgaacgtaaaaccgtccggacccaacgtacccgtccccgaacggtccctaccctactacgttcctaactacccacctactaccccaacgaccggacctacgtacggtacctccccgaacggtacctacgtaccttcgtacggttcggaccgtacggtcgggtacgtacgggacgtaacgtacggtttacccgtaccttaccgtacctaaccctacgtaccgtaacgaccgtacgtccgttacgacgtacgttacgtaaccggtaaagtttaccgttttcggttacctttaacgttttttaacttaccgttagtaccgttagtacgtaacgtttaagtacgttacggtaccgttaccggttcccgtttcccggttaccgtttacccggttacccgggttccccggttaacgggtaccccttaaacccggtttaacggttacccggtttaaacgttaaccccggttaaaaccggttaacccggttgggttaccgggttacccg

SEQ ID NO: 275160 - DNA, 773 bp, Homo sapiens
  misc_feature: GYAE6OF01BFWBE.44.3.A03.1.454.CMB.1.raw
tcagacagtatatacacgaccggtgctcgatttagagagcgtcacgaggggggggtctcaggaggcagcactctcgggacgtctccaccatggcctgggctctactcctcctcacgcctcctcactcgagggcacgacggggtcctgggggacttgtcctacccgtgactcacgccgcctcgagtcgtccgggactccgtggtcacggtcggtacacctattcttcgtgttccttccagccgaactacttccactcggtacctttaaagctctatcagtcggtacgcgacggtcggtccgggccgacgcccaagtccttcgtttacgcgtccgtttcgcgggtcgttcggctacgtccgtcggttccgtttttcggccttccgtacgtttccgtacgtaccgaccggtccggtcccgttcccgtacgtacctaacgtacccgtaaaccgtaaccgtcccggtaccgtggtaacggtacgtcggtacggtacgttacggttaccttttacggttttcggtcgttacggtacttaactttacgttacgtactttaccgtaacttaacgtaaacttacggttacgttacggttaaccggtacgggtaccgggccggtacgtacgtacgtccgttaccggtcgtacggtaccaccggtacccgtaaccgaaccccgtaacccgttcgtacgtaccgtacgttcctacccgttcccccggtccttacccgttactttacgttaaccttcgttacggttcgtacgggtcggtaccgggg

SEQ ID NO: 275161 - DNA, 684 bp, Homo sapiens
  misc_feature: GYAE6OF01BUJE7.44.3.A03.1.454.CMB.1.raw
  modified_base (548)..(548): a, c, t, g, unknown or other
  misc_feature (548)..(548): n is a, c, g, or t
  modified_base (558)..(558): a, c, t, g, unknown or other
  misc_feature (558)..(558): n is a, c, g, or t
  modified_base (669)..(669): a, c, t, g, unknown or other
  misc_feature (669)..(669): n is a, c, g, or t
tcagacagtatatacacgaccggtgctcgatttagagagcgtcacgagggggggggtctcaggaggcagcgctctcgggacgtctccaccatggcctgggctctgctgctcctcactctcctcaccaggacacagggtcctcgggcccagtctcgccctgactcagcctgcctccgtgtcgtgggtcgccgtggacagtcgtcactatctcctgcctactggagccagacggttaattagttcttagttactttaactttgtcctccgttaggtacttaccaactactacctactaccgtaaacggtaaacccgtaccccctaaacgtactaactactaacttaccgtaagtcggtaacggtaccttaagtaacggaccggttccctacgggttaacggggtttactaacgttccgtccttactacgtcgtaccctaccgtaacggtacccgacctaaaccggccgtccctaccgacgaactacgtctacggtcggtcgtcgacggtcgaggaacggcgaggtcttaataatttgttattggttaacncgtataggtnttccggttcgtcgatacgttactacgtttagtggttaccgtaggtaacgacggtaccgtaggtacccgtacgtcgtaggccacggaccgtaccgacccctacctacgtacncctaccgtctacccc

SEQ ID NO: 275162 - DNA, 667 bp, Homo sapiens
  misc_feature: GYAE6OF01AOM7Q.44.3.A03.1.454.CMB.1.raw
  modified_base (144)..(144): a, c, t, g, unknown or other
  misc_feature (144)..(144): n is a, c, g, or t
  modified_base (170)..(170): a, c, t, g, unknown or other
  misc_feature (170)..(170): n is a, c, g, or t
  modified_base (208)..(208): a, c, t, g, unknown or other
  misc_feature (208)..(208): n is a, c, g, or t
  modified_base (462)..(462): a, c, t, g, unknown or other
  misc_feature (462)..(462): n is a, c, g, or t
  modified_base (530)..(530): a, c, t, g, unknown or other
  misc_feature (530)..(530): n is a, c, g, or t
tcagacagtatatacacgaccggtgctcgatttagagagcgtcacaggggagagctctggggaggaactgctcagttaggacccagacggaaccatggaagcccagctcagcttctcttcctcctgctactctggcctcccagngatcaccggagatattgtgttgacanagtctcaggcacccttgtctttgtcctccggagggganagacgcccaccctctccgtggacgggccaaggtcgggagttcgttgacttaacggtacctagtcccgtaggtacccaaagacgaaaccgtggacccaggtccctccgacggtcctacctcacttcgtatagtatcgactactacccgaagtacgggtctacgtccggacccaaccccgtaaggaccgtacggttccagggttccgacgtagggtacggtcggtaggaccgtacgtcttaccgacgttccgtacnccggtacacgtactaacgtcgtacacgtaccgtagtaactttgttctatttacgttattacgtgtacngtaccgtacgttccgtaccgtcgacgtacccgtcgttccgttaccgggtccggggacggggtacagggtcgagtaccgtacggaacgaacggtcggtcggtacgtcctacggacctaccgtgttccgtcgttacccg

SEQ ID NO: 275163 - DNA, 510 bp, Homo sapiens
  misc_feature: GYAE6OF02I4MMR.44.3.A03.1.454.CMB.1.raw
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (408)..(408): a, c, t, g, unknown or other
  misc_feature (408)..(408): n is a, c, g, or t
tcagacagtatatacacgaccggtgctcgatttagagagcgtcacaggggagagctctggggaggaactgctcagttaggacccagacggaaccatggaagccccagcgcagcttctcttcctcctgctactctggctcccagacaccactggagaaatagtgatgacgcagtctccagccacctgtctctgtctccagggaagagccaccctctcctgcagggccagtcagagtgttggcagcagcgtagcctggtccagcagaacctggccagacctcccgaggcctcctcatctataccacatccacnggcccatggactcccgagccagnttcagtcgcacgtgggtctacgggacagtacgttccactctcaccgatccagcacgcctgcacgtctagaactntttgctagtttatacgtgtcagtctagtatatgactcgtcctccgtacggacgaaggcctaacgcgtaggtagtaacttaacggactgtacggtctagtacc

SEQ ID NO: 275164 - DNA, 539 bp, Homo sapiens
  misc_feature: GYAE6OF02FTWM2.44.3.A03.1.454.CMB.1.raw
  modified_base (207)..(207): a, c, t, g, unknown or other
  misc_feature (207)..(207): n is a, c, g, or t
tcagacagtatatacacgaccggtgctcgatttagagagcgtcacaggggagagctctggggaggaactgctcagttaggacccagacggaaccatggaagccccagcgcagcttctcttcctcctgctactctggctcccagacaccactggagaaatagtgatgacgcagtctccagccaccctgtctctgtctccaggggaaangccaccctctcctgcagggccagtcagagtgttggcagcagcgtagcctggttccagcagaaacctggccagactcccaggctcctcatctataccacatccacacgggccactggtactcccagccagattcagtggcacgtgggtctgggacagagttcactctcaccatcagcacgcctgcagtctgaagtatttgactagtttattactgtctagcacgtcgttcctccgacggtcccgtcttctaccggtttccggggccggggggtaaccgtaacggggtggacggtacgtacgaacggtaaccgtaacgtcggtacggtcgtcgg

SEQ ID NO: 275165 - DNA, 554 bp, Homo sapiens
  misc_feature: GYAE6OF02F1X51.44.3.A03.1.454.CMB.1.raw
  modified_base (444)..(444): a, c, t, g, unknown or other
  misc_feature (444)..(444): n is a, c, g, or t
tcagacagtatatacacgaccggtgctcgatttagagagcgtcacagggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccgggccgagcccccaaagtcctcttttacgacgtcctttcgcgggcttcggcagtccctggccgtttttcggcctccagttctgaccacgcggcctccctgaccatcaccaaactccggcctgaggatgaggctgactacttttgttgtgcatatttcgatttcactcaaattntgtcttcggaagtgggacccgcgtcagcgtcctgcgtcacgcccaaggcccaaccccatcgtcacctctcgttccccgccctccttctatcttactgttctgagtccggg

SEQ ID NO: 275166 - DNA, 602 bp, Homo sapiens
  misc_feature: GYAE6OF02GRGV5.44.3.A03.1.454.CMB.1.raw
  modified_base (208)..(208): a, c, t, g, unknown or other
  misc_feature (208)..(208): n is a, c, g, or t
  modified_base (337)..(337): a, c, t, g, unknown or other
  misc_feature (337)..(337): n is a, c, g, or t
tcagacagtatatacacgaccggtgctcgatttagagagcgtcacaggggagagctctggggaggaactgctcagttaggacccagacggaaccatggaagccccagcgcagcttctcttcctcctgctactctggctcccagacaccaccggagaaattgtgttgacgcagtctccaggcaccctgtctttgtctccgaggggaaangccaccctctcctgcagggccagtcagagtgttaccagcaacttagcctggtaccaccagaaacctgggcaggcctcccgaggcctcctcactctagtcggaacactccaccgagggccacgtggtacnccccaccgtaggttcaggtcggcgtaggtcggggtaccggactaggtacgttcactctacacatcgagcgctgctagtctgaggtatttgacgttagtttacttacgttgtactagtactaagttaatagtcgtacgtcggtcccttcccgttcgggacctaacgggtaccacggtacgtaggaacgtaacgttaacgacgtaggtcggctacggaccaaccgtagttccgtagttaccgttactacgttcccgtaccccgtacc

SEQ ID NO: 275167 - DNA, 568 bp, Homo sapiens
  misc_feature: GYAE6OF02GPK8N.44.3.A03.1.454.CMB.1.raw
  modified_base (207)..(207): a, c, t, g, unknown or other
  misc_feature (207)..(207): n is a, c, g, or t
tcagacagtatatacacgaccggtgctcgatttagagagcgtcacaggggagagctctggggaggaactgctcagttaggacccagacggaaccatggaagcccagcgcagcttctcttcctcctgctactctggctcccagacaccactggagaaatagtgatgacgcagtctccagccaccctgtctctgtctccgaggggaaangccaccctctcctgcagggccagtcagagtgtggcagcagcgtagcctggtccagcaagaacctggccagacctcccaggtcctcctcatctataccacatcccacagggccacgtggtactcccagccagtacttcagtcgctacgtgggtctcgggatacgtagtttccactctcacctactacagcacgcctcgcgtacgtagtacccccccgtaagttatttagtcgtacgtttattacgttagtcgtacgtacgtagtattagtacgtacgttcgtccgttccgttcgttaccgttccggtccgtaccggtaccgtacgtacgtacgtacgttacgtaacgtacgtacgtggtacg

SEQ ID NO: 275168 - DNA, 538 bp, Homo sapiens
  misc_feature: GYAE6OF02IHW9H.44.3.A03.1.454.CMB.1.raw
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
  modified_base (513)..(513): a, c, t, g, unknown or other
  misc_feature (513)..(513): n is a, c, g, or t
tcagacagtatatacacgaccggtgctcgatttagagagcgtcacaggggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatctcctgcattggaaccagcagtgacattggganatataaccttgtctcctggtatcaacaacatccaggacaaacgcccccaaactcatcatctatgaggcctataagngccctgagggtttctaatcgcttcactgcctacagtccgcaacncggcctccngacatctcgtggctccgnggctgaggacgaggctgtattattattgttgctcagtntgttcgtcgcattcactttatcgttcttacggaagttcggaacctaggtcctaccgtcgtaaggtccacgacccgaagaccccaacccnctgacctacttccgtccgtcccccg

SEQ ID NO: 275169 - DNA, 325 bp, Homo sapiens
  misc_feature: GYAE6OF02IYRAG.44.3.A03.1.454.CMB.1.raw
  modified_base (312)..(325): a, c, t, g, unknown or other
  misc_feature (312)..(325): n is a, c, g, or t
tcagacagtatatacacgaccggtgctcgatttagagagcgtcacagggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatctcctgcactggagccagcggtcacgcccaaggcccaaccccatgtccactctcgttccccaccctcctctatactactgtctgagcggctggacaaggcgcatagnnnnnnnnnnnnnn

SEQ ID NO: 275170 - DNA, 678 bp, Homo sapiens
  misc_feature: GYAE6OF02HIF3X.44.3.A03.1.454.CMB.1.raw
  modified_base (208)..(208): a, c, t, g, unknown or other
  misc_feature (208)..(208): n is a, c, g, or t
  modified_base (311)..(311): a, c, t, g, unknown or other
  misc_feature (311)..(311): n is a, c, g, or t
  modified_base (451)..(451): a, c, t, g, unknown or other
  misc_feature (451)..(451): n is a, c, g, or t
tcagacagtatatacacgaccggtgctcgatttagagagcgtcacagggggagagctctggggaggaactgctcagttaggacccagacggaaccatggaagccccagcgcagcttctcttcctcctgctactctggctcccagacaccactggagaaatagtgatgacgcagtctccagccaccctgtctctgtctccgaggggaangccaccctctcctgcagggccagtcagagtgttagcagcaacttagcctcgtaccagcaagaaatctggccaggcctcccgaggcctcctcattcctatggtncactccacgacgggccacgtggactcccgagtcctaggttcagtcggcaggttcgggtcgtagggacaggtcgttccgactccgtcaacctactacgacgaccacggtccctacgaccgtacgttcgtacggtaaagttntttttacgggactttaacggtttttacgttaaccgtttggtacctaaggtaccgttaaaggttaacttaaagttcggaaaccgtttcgggtaccccctttccggttaccgggtaacccgggtaaacggggacccttaacccgggtaaccggttaggggtaaacccgttaaacgtttaaaacccggggtaaccgtttagggtaacccgggtacttccggtaaaccccg

SEQ ID NO: 275171 - DNA, 639 bp, Homo sapiens
  misc_feature: GYAE6OF02HRPZH.44.3.A03.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
tcagacagtatatacacgaccggtgctcgatttagagagcgtcacaggggagagctctggggaggaactgctcagttaggacccagacggaaccatggaacgcccagcgcagcttctctcctctgctactctggctcccagacaccactgganaatagtgatgacgcagtctccacgccacctgtctctgctacgaggggaancgtccacctctcctgcagggccacgtcacggagttgtggacaggacaggcgtagtccgttcggttaccagcaacgaaccgtcggacaacgccncccgaggctccgttanactctacacaccnctaccacgcggcctaagtcggtaccnccaggcaggttactcgagtcgaccgtagtcggtacgtgggaactagtacgttccacgtcgtactaccgactacgacgtaccgagcccgtagaccgtagtacccgtagtaacgttacttttaggacttaacgttttacttacgtttacgtacgtacgtaacgttaagttacggtacgttacggacgtttaccggtcccttaccggtttacttccggtttacccggtcccgtacgtcccgtaaccgttacgtaccggttattaacccgtaaggtacttcggtggtacccg

SEQ ID NO: 275172 - DNA, 608 bp, Homo sapiens
  misc_feature: GYAE6OF02IRJ50.44.3.A03.1.454.CMB.1.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (376)..(376): a, c, t, g, unknown or other
  misc_feature (376)..(376): n is a, c, g, or t
tcagacagtatatacacgaccggtgctcgatttagagagcgtcacagggggagagctctggggaggaactgctcagttaggacccagacggaaccatggaagccccagcgcagcttctcttcctcctgctactctggctcccagacaccactggagaaatagtgatgacgcagtctccagccacctgtctctgtctccaggggaaangccacctctcctgcagggccagtcagngtgttggcagcagcgtagcctggttccagcagaaacctggccagacctcccgaggcctcctcatctaactaccacactccaccgacgggcctactcggtactcccagccagattcagtcggcacgtgggtctgggacaggtnttcactctacaccatcagcacgtcctcgcgagttcgtagtaagttacgttttgacttagtttttacttacgttgtacctagtacgtaagttaagttacggtacgtaccgttacggcccgtttacccgtttcgttaaccggttttcccggtaccccggttacgggtaacccctacggttacgttacccggttaacttttaacccgaaacggttaaccgttggtacggttaccg

SEQ ID NO: 275173 - DNA, 862 bp, Homo sapiens
  misc_feature: GYAE6OF02IQ64F.44.3.A03.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (357)..(357): a, c, t, g, unknown or other
  misc_feature (357)..(357): n is a, c, g, or t
tcagacagtatatacacgaccggtgctcgatttagagagcgtcacaggggagagctctggggaggaactgctcagttaggacccagacggaaccatggaagcccagcgcagcttctcttcctcctgctactctggcctcccagcaccactggagaaatgtgatgacgcagtctccagcccaccctgtcctctgtctccgaagggggaaancgcccaccttctccgtgacacgggccagtcaacgnggtgttcggcaggcaggcgtagccgttcggttccagtcgaacgaacccgtggacccaagtaccctcccggaggtccctaccctacgtacgttacctactaacccgactaccncccgtaaccggaccgggtacccctaacggttccggttaaccctacccccgaacggttacccgtaaagtaccgttttacccgggaacggttaccgggtaccctaaacggggttccggggttaaccgtacccggggggtaaacttaaaccgggggttactttacccgggtaaccctttacccggttaacccggtaacccgtaaccggttaccaaccgggtaaccgtaccggtacccgttacggtacctaaccgggttacctaagggttaaaccgtttacgtttttacgaacgttttaccgtttaaacttttcccggttaagttaccgtaaacgttacgtaacggtttaaacgttcggttacgtaacggttccggttacccgttaccgttttaccggttacccggtttttcccgggcccggttaccgggttacccgtaccgtttaaccggttaccggttaaacctttaccggtaaaaccggtaccggtttaggtcccggttaacccgg

SEQ ID NO: 275174 - DNA, 654 bp, Homo sapiens
  misc_feature: GYAE6OF02HLEBK.44.3.A03.1.454.CMB.1.raw
  modified_base (312)..(312): a, c, t, g, unknown or other
  misc_feature (312)..(312): n is a, c, g, or t
  modified_base (327)..(327): a, c, t, g, unknown or other
  misc_feature (327)..(327): n is a, c, g, or t
  modified_base (405)..(405): a, c, t, g, unknown or other
  misc_feature (405)..(405): n is a, c, g, or t
  modified_base (518)..(518): a, c, t, g, unknown or other
  misc_feature (518)..(518): n is a, c, g, or t
tcagacagtatatacacgaccggtgctcgatttagagagcgtcacaggggagagctctggggaggaactgctcagttaggacccagacggaaccatggaagccccagcgcagcttctcttcctcctgctactctggcctcccagacaccactggaagaaatagtgatgacgacagtctccacgccacccgtgtctctgtccacgaagggggaaacacgcccacctctcctgcgacgggcagtcagtaggtgtggcagcaggcgagccttggtccagcaacggtaacctggaccagaccctccgagcctcctnactctaactacccanactacccgacgaacgggcctaacgtacgtaaccacccagtaccaagttacttcgaagtcggtacacgttggggtaccncggggaaactacgggtaccgtttacaccgttcctaccaaccgtacgacaggccctaggcctacggactacgtacgtttaagaaccgtttatttacgtcgttaacggttttaanacgttcgtacgagtaccgtaagtagtagtacggtactccgggtaccttccgttacgttcccgtcgggtcccttaacggggaccctaacggttcgttaacctacgtttaaaccgaaaccggtacgtggttacgaccg

SEQ ID NO: 275175 - DNA, 799 bp, Homo sapiens
  misc_feature: GYAE6OF02IRG38.44.3.A03.1.454.CMB.1.raw
  modified_base (211)..(211): a, c, t, g, unknown or other
  misc_feature (211)..(211): n is a, c, g, or t
tcagacagtatatacacgaccggtgctcgatttagagagcgtcacagggggagagctctggggaggaactgctcagttaggacccagacggaaccatggaagcccagcgcagcttctcttcctcctgctactctggctcccagacaccactggagaaatagtgatgacgcagtctccagcccacctgtctgtcgtcctccgaggggaaacncgcccacctctcctgcacgggccagtcgagtacgtgtaccagtactaacttacgccgtacggtaccaaccgaacgaaaccggtggacgaaccgggcctacccggacggtcccttacccgtactacttaccgttagtaggtactcgtacctaacgtaccgaaagggttaccgggcccggacgggacctaaccgtaccccgaacggtcccgtacgggttaccgaggttcggacgtacggggttcggtccgtagtacgaacgtaccgtacttcgtaccctcgtacgaaccctacgtaccgaccgggtccggtaccgtaacggaaccggtacccgggttaaggtttacggttttaacgtaacgtttaacggttttaacttaccgtaacgttaaccgtaaaccgtaccggtaaccgtccggtaacgttccgggtaacccgtttaacgggttaaccggttacggtttaaccgggacccgggtaacggggtaccgtaaaccgggtcgggtaacgggtaaccgttaaccgtaaccggtaaacgttaaccggttacgggtaccggttacggtaccgtaccgtaccgtagtttcccgg

SEQ ID NO: 275176 - DNA, 928 bp, Homo sapiens
  misc_feature: GYAE6OF02JNT33.44.3.A03.1.454.CMB.1.raw
tcagacagtatatacacgaccggtgctcgatttagagagcgtcacaggggagagctcgtggggaggaactgctcagttaggacccagacggaaccatggaagccccagccgcagcttctcttcctcctgctactctggctcccagacaccacgtggagaaactagtcgatgaccgtcagtcctaccgagccctacccgttgtctcggttctcctacggggaaacggaacggaccgaccccttaccgtcccgtttcgaccgaccgggaccgacggttccacggtaaggtggttcggtcccgtaaggccgacgtaccggtacggtaccgtcggttacccgttcggaccgacgtaaaccggtaccgtaccgtaccggtacgtacccgaacggccgtaccgtccgtacgtaccttccgggtaactaccgtaccgtacctaccgggaaccctaacgggcccgtaacgttccggttaacgtccccgaacggtccctaacggaccgtttacgaaccgttcggtaccgggtacggtttacggggtaccgttacggggaccgttaacggaacgtttacctaaccgtaccgtaccgttaacccgacgttcccgaacggtacccgttaacggcccgtttacggcccgttaacggtaccggttagtttaacggtaaccgttttcggttaacctttacggttttaacgttttaccgtacgtttacgtaaccggttacgtaacgtttaacgttaacgttaaccggttcccgtttaacccggttacccggtttacccggttaaccggggtaaccgtaaacccgggggtttaccctaaaccccgggttaaccggttaaaccgggtttaaccgggttaaacccgtttaaaccgggtaaacccgggtttaccgttaacggggttccccgtaacggttaaaccccgg

SEQ ID NO: 275177 - DNA, 749 bp, Homo sapiens
  misc_feature: GYAE6OF02GMZTM.44.3.A03.1.454.CMB.1.raw
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
tcagacagtatatacacgaccggtgctcgatttagagagcgtcacagggggggggtctcaggaggcagcactctcgggacgtctccaccatggcctgggctctactcctcctcagccctcctcactcagggcacagggtcctggggactgtctaccctgactcagcccgccctcagtcggtccgggactccgtggtcaggtcgtcaccntcttctgttctcagcacattccactcggtaccctttaaagtcctactagtcgtcggtacncgtaggtcggtccccgggaccgaccgtcccctaaaacgttccttccgtttaccgaccgttccgttcggcgggtcttcggctacgtccgtcggttccgttttcggcctcgtagttcctcgaccacgccgtccctccgtcgacctactaccaaccgaaccgtcccggtaccgttacggaaggtacgtcggacgtccgtacgttaccttttacgttttcgtggttcacgttagttacgttttcgtactttcgtaactaactaaacttagttcggttacgttacgggtaacgggttaccgggtcccgtacggttcaccggttccgtccgttaccggtctaccgaccggtaacccgtaaccggacccctaaacccgtcgttacccgaccttaaccgttcccgtttccggttaccccgtccccttaccgttacttaaccgtaccgttacgttccgttacgtaccgggtaccggtcgggttacccgg

SEQ ID NO: 275178 - DNA, 753 bp, Homo sapiens
  misc_feature: GYAE6OF02GW59K.44.3.A03.1.454.CMB.1.raw
  modified_base (276)..(276): a, c, t, g, unknown or other
  misc_feature (276)..(276): n is a, c, g, or t
tcagacagtatatacacgaccggtgctcgatttagagagcgtcacgagggggggggtctcaggaggcagcactctcgggacgtctccaccatggcctgggctctactcctcctcagcctcctcactcagggcacgagggtcctggggactgtctaccctgacctcacgcccgtccctacgaggtcgtccgggactccgtggtcaggtcgtcaccatcttctgttcctccgagcgatacttccagtcggtaacctttaagctctatcgagtcggacncgtacgtcgggtcccggcgaccgacccctaagtccttcttacgtaccgtcctttcggccggtctcggcctcgtcctggttccttttcggcctcgtacgttcgtacgtaccgaccgtccggtacctccgtgaacctacttacccgaaccgttaaacccgtcccggacgttacgggaacgtacgttaggaaccggtccgtacgttacccgttttaagtttcggttcgtcggtacttaacgtttactttaccggtacttacctaacgttaacgtaaacttagttaccgtttcggttaaccggtaacggttccggggtacccgtcgtacgtacggtaccgtccgtcgtaccgttccgaaccgttacccgaaaccgtccccgtaaccgtcccgtacgttaccctaaccgttcgttacccggttccccgtacccgttcccttactaacttaccgttaccgtcgtaccgtcggtacgttccggg

SEQ ID NO: 275179 - DNA, 896 bp, Homo sapiens
  misc_feature: GYAE6OF02F0QKF.44.3.A03.1.454.CMB.1.raw
  modified_base (101)..(101): a, c, t, g, unknown or other
  misc_feature (101)..(101): n is a, c, g, or t
tcagacagtatatacacgaccggtgctcgatttagagagcgtcacaggggagagctctggggaggaactgctcagttaggacccagacggaaccatggaanccccagcgcagcttctcttcctctgctactctggctcccagacaccactggagaaataggtgatgacgcaggtcctccgagccctaaccccgtgtcctctcgtcctaccgaagggggaaaacgcgcccctacccctctcctcgcgtacgggccagtcagtagtggtgcagcgacgcgtacgtccgttcggttacccaagccgtaaacggaaacccgtacgggacccgtaacgtaacccctaccccggtaacggtcccgttaccccttactaccttacctaaccttaacccaaccacctaccccgaccgaccggggtacccaccgttaccggtaaccgtccccgtacgaccgtaacggtacttaccgtacgggtcgtacctacggtcgggggttaccgtacggggaacttacgggtaccggtttacctaccgttaccctacccgtaaaccacgtacgtacgtaccgtaccggtccgtaccggtccttaacggttacgttaacggttaacggttactttttacggtaaccgttttacggtttttacttttaaccggttaggttaccgtaaaccgggttaacggtttaaacgttaacgttttaagttaaccgggtcgttaacccgggtttaccccgtttacccgttttaaccccgggtttcccggtttttaacccccgggtccccggggtttaacccgggtaaccccgttacgggtttaaacccgtttacccggtttaaccggttttaaacccggtaaaccgggttaaccgggtttccgggtaaccgggtttacccgg

SEQ ID NO: 275180 - DNA, 657 bp, Homo sapiens
  misc_feature: GYAE6OF02INGJK.44.3.A03.1.454.CMB.1.raw
  modified_base (215)..(215): a, c, t, g, unknown or other
  misc_feature (215)..(215): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagacagtatatacacgaccggtgctcgatttagagagcgtcacgagggggagagctctggggaggaactgctcagttaggacccagacggaaccatggaacgcccagcgcagcttctcttcctcctgctactctggcctccagactaccaactggaagtaaatagtgatgacgcggtctccagccaccctgtctgtgtctaccgaaggggaanacgcccacccttctacccgtgaccgacggacctagtcaggtagtgtacgcaagacaacttagcctacgtacanacaanaatcgtagacacggcctaccgaggtccttaccgtactagttacgtagtggtacactactacccgaacgacggcctacgtagtacctccgacgaccgtagtacgaggtcgacgtaggtacggtcgtaaggacgtacgtacggttaccaacgttccgtacaactacgtacagtacacgtactacggtacacgttagtaagtaagttacgtttacgaacgtttatttaacttagtactaacgtacgtagttaaactaatagtaccgtacgtaccgtaccgtaccgtacggaacgtaacgggtaactaaccggacgttaaggaaacgtttaaacgtaacgtagttacgtaggtaaccgtcgaactacc

SEQ ID NO: 275181 - DNA, 1004 bp, Homo sapiens
  misc_feature: GYAE6OF02HBD8M.44.3.A03.1.454.CMB.1.raw
  modified_base (228)..(228): a, c, t, g, unknown or other
  misc_feature (228)..(228): n is a, c, g, or t
  modified_base (987)..(987): a, c, t, g, unknown or other
  misc_feature (987)..(987): n is a, c, g, or t
tcagacagtatatacacgaccggtgctcgatttagagagcgtcacaggggagagctctggggaggaactgctcagttaggacccagacggaaccatggaacgcccagcgcagcttctcttcctctgctactctggcctcccagaccaccacgtaggaagaatagtgactgaccgctacgttctccagcccaccctgtctccgttgttaccgaccggaagggggaaacnccgtaccccacccttcgttccgtcggaccggacggggtcccttaacggccgtaacgggttggtttcgggttaccggaacggtaccggacggtaacggtcggttaacccggttccggtttccggggttaaccaacgggaaccgtaaaccggtaaaccccggttcgggaacccgaaccggttacccccttaccggaaccggttacccctttccccttaacgtaccgtttaacgtttaacgcggttacccgttaccgtaccctaaccgttaacccggtaaaaccgggtccggttacccgtaccggtaacccgggaccccctaacccggtaagggtaaccggtttaaccgggtaccgtacggggtaccgggtacggttacggggttccggttaccgggtaacgggacctttaacgtctttacccgtacgtttccgtaacccgggtaccgtcggtaacccggttccgaccggttaccctaggtacccggttagtaaacccgggttttgttaaacccggtttttggttaccggttaacgtttaacgggtttttactttaacccggtactaccgtaaagggttaactttaacggtttaaacttaacggttccggttaaacccgggtttcccgttacccgggttttaacccccgggacccggggaaaacccgtttcggggaaacccgtttaccgggtaaccgggttaacggtttaaaccggtttaaccggttaaacccggcgggttttaacggacccgggtttaacnccccggtttaaacccgg

SEQ ID NO: 275182 - DNA, 796 bp, Homo sapiens
  misc_feature: GYAE6OF02H3OUM.44.3.A03.1.454.CMB.1.raw
tcagacagtatatacacgaccggtgctcgatttagagagcgtcacgaggggggggtctcaggaggcagcactctcgggacgtctccacatgcctgggctctactcctcctcacgcctcctcactcagtcacagggtcctggggactgtcctaccctgactcacgcccgcctcagtcgtccggactccgtggtcagtcggtcacctatcttctcgttctccagcgactacttccactcggtaccctttaaagtctacgtactcgtagttacggtaccgcgtacgggtccggtaccccggggaccgtaacccgtaaccccccgtaaaacgttccccgtttaaccggtttttaacccgtacccggttttccccggtttaccgggtccggggttcccgtttaccggtccgtaaccgggtttccccggttcgggtttccccggtttttccggccccttaccgttacggtttccgtacgaacccgtccggtcccggtccccttccgtaccggaaccctacgtaacctaacccgtaacccgtcccggtacgtcggtaacggtacgtacggtacggtccgtacgttacgttttaccgttttggtacttcgtacgttactttacgttactaactttacgtacttaactaagttcgttcgtttacgtagggtacgtcggtacctcgtacgtgtccgtcgtcgtcgtacgaccgaccgacgacccacctgtcgtacctcgtcctcccggttccctacccttccgtactttacgtccttacgttcggtaccgtggttaccggtaccgg

SEQ ID NO: 275183 - DNA, 769 bp, Homo sapiens
  misc_feature: GYAE6OF02HYJOQ.44.3.A03.1.454.CMB.1.raw
  modified_base (224)..(224): a, c, t, g, unknown or other
  misc_feature (224)..(224): n is a, c, g, or t
tcagacagtatatacacgaccggtgctcgatttagagagcgtcacaggggagagctctggggaggaactgctcagttaggacccagacggaaccatggaacgcccagcgcagcttctcttcctcctgctactctggctcccagacaccacgtggaagaaatagtgatgacgctagtcctccacgccctaccctgtccttctcgtcctaccgaagggggaaaacncgcccctaccctcgtcctggcgacgggcctagtcgaggtacgttcgttaaccagactaaacgttacggcccttacggaacccaaccgaaacggaaacccgtcggggacctacggtccctacccggaaggtcccttccgtactaacttcgtaagtacggaaacctcgtaccccacggtaccggacctaacgttcggtaacctccccgaaccgttacggttacgacggttacggaccgtagggtcgggtacccgggaactaggtaccgttaccaccttaccgtacctaaccgcgtaccggacggcccggtactcggtacgtacggttcgttaaggtacgttacgtttcgtacgttaaggttttactacgttacgtactaacgacgttaacgtttaataaagttaccgtcgtaccttacgtaccgttaccgggtttccggggaaaccggtacggtaagggtacgtacgtacgtaacggaaacgtcggttaggtcggtaccgtacgtaccgtaccgttagttaccgttcgtttaccgtacgttaccccg

SEQ ID NO: 275184 - DNA, 504 bp, Homo sapiens
  misc_feature: GYAE6OF01C3H7B.9.50.E06.1.454.CMB.1.raw
  modified_base (204)..(204): a, c, t, g, unknown or other
  misc_feature (204)..(204): n is a, c, g, or t
  modified_base (499)..(499): a, c, t, g, unknown or other
  misc_feature (499)..(499): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaacctggccaggctcccaggctcctcatctatgatgcatccaacagggccactggcatcccagccaggttcagtggcaggtgggtctgggacagacttcactctcaccatcagcagactagagcctagaagtattttgctagtttattactgtcagcagcgtagcaactggcctcggtacgttcggccgaacggaccaaagtggacgatacaaggcgaactgtggctcgcaccntctcg

SEQ ID NO: 275185 - DNA, 515 bp, Homo sapiens
  misc_feature: GYAE6OF01BZS07.9.50.E06.1.454.CMB.1.raw
  modified_base (204)..(204): a, c, t, g, unknown or other
  misc_feature (204)..(204): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (509)..(509): a, c, t, g, unknown or other
  misc_feature (509)..(509): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactcncaccatcagcagactagacncctagaagtattttgctagtttattactgtcagcagcgtagcaactggcctcggacgttccggaccgaacgggaccaaaggtcggaacactacgaaggcgaactggtcgctcgacacctntcgtcg

SEQ ID NO: 275186 - DNA, 504 bp, Homo sapiens
  misc_feature: GYAE6OF01CJ2RK.9.50.E06.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (499)..(499): a, c, t, g, unknown or other
  misc_feature (499)..(499): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaaacctggccaggctcccaggctcctcatctatgatgcatccaacngggccactggcatcccagccaggttcagtggcagtgggtctgggacagacttcacttctcaccatcagcagactagagcctagaagtattttgctagtttattactgtcagcagcgtagcaacgtggcctcggacgttcggaccgaacgggaccaaagtaggacatacaagcgaactgtggctgacacntctcg

SEQ ID NO: 275187 - DNA, 565 bp, Homo sapiens
  misc_feature: GYAE6OF01DGIVC.9.50.E06.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (288)..(288): a, c, t, g, unknown or other
  misc_feature (288)..(288): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctcaggggaaangccacctctcctgcagggccagtcagngtctaggnctccttagctggtatcaacagaaacctggaccaggcctcccgaggctcctnatctatgatgcatccaacgacgggccacgtggcactcccagccaggttccaggtcgggacaggttgggctgggacaggtacttcactctacacctatcagcaagactagacgccgtagtaacgtagttttgcttagtttacttactgtctagctaggtacgttagacaacgtcggaccgtacgggtaccgttacggaccgtaaacgggaccgaaaggtacggacgtaacgtagaacgcgtaacgtgtaggtaccgtacggacaccgtagtcgttacg

SEQ ID NO: 275188 - DNA, 545 bp, Homo sapiens
  misc_feature: GYAE6OF01AQZ59.9.50.E06.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (313)..(313): a, c, t, g, unknown or other
  misc_feature (313)..(313): n is a, c, g, or t
  modified_base (537)..(537): a, c, t, g, unknown or other
  misc_feature (537)..(537): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttagganctccttagcctggtatcaacagaaacctggccaggctcccgaggcctcctcatctatgatgcatccaacngggccactggcatcccagccaggttcagtggcaggtgggtctgggacagtacttcactctcaccatcgagcagactagacgccgtagaagtatttgactagtttatactgtcagcaggtcgtaacgcaacgtggtacctcgggtacgttcggaccgtaagggacctaaaggtcggaacgagtacgaacggccgtaaacgtggtacggtacgtacgaccaccgtnttccgtcg

SEQ ID NO: 275189 - DNA, 511 bp, Homo sapiens
  misc_feature: GYAE6OF01CWALN.9.50.E06.1.454.CMB.1.raw
  modified_base (204)..(204): a, c, t, g, unknown or other
  misc_feature (204)..(204): n is a, c, g, or t
  modified_base (506)..(506): a, c, t, g, unknown or other
  misc_feature (506)..(506): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggcctcccaggctcctcatctatgatgcatccaacagggccactggcatccccagccaggttcagtggcaggtgggtctgggacagactttcactctcaccatcagcagactagagcctagaagtattttgcttagtttattactgtacagcagcgtagcaacgtggcctcggacgttcggaccgaacgggaccaaaggtggacagtcaagcgaactgtcgctgacaccntctcg

SEQ ID NO: 275190 - DNA, 533 bp, Homo sapiens
  misc_feature: GYAE6OF01ECQPP.9.50.E06.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaacctggccaggctccaggctcctcatctatgatgcatccaacngggccacgtggcactcccagcccaggttcagtggcaggtgggtctgggacagacttcactctcaccatcagcagactagacgcctagaagtatttgctagtttattactgtcagcagtcgtagctaacgtcggaccgtcggtacgttcgggaccgaacgggacccgaaaggtcggaacgacgtacaacggcgaacgtggacggtcgtacgaccactgtcgttacg

SEQ ID NO: 275191 - DNA, 504 bp, Homo sapiens
  misc_feature: GYAE6OF01DSH6O.9.50.E06.1.454.CMB.1.raw
  modified_base (204)..(204): a, c, t, g, unknown or other
  misc_feature (204)..(204): n is a, c, g, or t
  modified_base (499)..(499): a, c, t, g, unknown or other
  misc_feature (499)..(499): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctcctagcctggtatcaacagaaacctggccaggctcccaggcctcctcatctatgatgcatccaacagggccactggcatcccagccaggttcagtggcaggtgggtctgggacagacttcactctcaccatcagcagactaagagcctagaagtattttgactagtttattacttgtcagcagcgtagacaacgtggccgtcggacgttcgacgaaggaccaaagtgacatacaagcgaactgtggctagcacntctcg

SEQ ID NO: 275192 - DNA, 526 bp, Homo sapiens
  misc_feature: GYAE6OF01B24EU.9.50.E06.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctccaggggaaangccaccctctcctgcagggccagtcagagtcttagganctccttagcctggtatcaacagaaacctggccaggctcccaggctcctcatctatgatgcatccaacagggccactggcatcccagccaggttcagtgcagtggctgggacngactnactctcaccatcagcagactagagcctagaagtatttgactagtttatactgtcagcagcgtaagctaacgtgcctcgggacgttcggaccgaacggggtaccaaaggtacgggaactacgtacgaacggcgaaacgtggtggaccgtacgaccacctagtcgttacg

SEQ ID NO: 275193 - DNA, 506 bp, Homo sapiens
  misc_feature: GYAE6OF01D775W.9.50.E06.1.454.CMB.1.raw
  modified_base (374)..(374): a, c, t, g, unknown or other
  misc_feature (374)..(374): n is a, c, g, or t
  modified_base (501)..(501): a, c, t, g, unknown or other
  misc_feature (501)..(501): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcaggtgggtctgggacagacttcactctcacntcagcagactagacgcctagaagtattttgactagtttattactgtcagcagcgtagcaacgtggcctcggacgttcggccgaaggaccaagtaggacagtacaaggcgaactggtagctagacacntctcg

SEQ ID NO: 275194 - DNA, 534 bp, Homo sapiens
  misc_feature: GYAE6OF01A4E71.9.50.E06.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaaacctggccaggctccaggctcctcatctatgatgcatccaacngggccacgtggcatcccagccaggttcagtgcaggtgggtctgggacagcttcactctcacatcagcagactagagcctagaagtatttgacttagtttacttacgtgtcagcagtcgtagccaacgtcggacccttcgggaccgttcgggaccgtaagggaccgaaagtcggaacgagtacaacggcgtaacgtggtacggtctcggaccaccgtagtcgtacg

SEQ ID NO: 275195 - DNA, 737 bp, Homo sapiens
  misc_feature: GYAE6OF01BNPN2.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagccaccctctcctgcagggccagtcagagtcttaggagctcttagcctggtatcaacagaacctggccaggctcccgaggcctcctcatctatgatgcataccaacgacgggcccaacgtcggaccaacgttccccaaggtcccgtaaggttccaagggtcggaccgtagggtcggggtcgtaggggaactaggtacctttaccaacttccgtaccaaccctataccgagaccaaggtaccgttaacggacgtaccgtaggtaaagttagtttttacggaccttttaaggttttaacgtttacgttacggtaccgtaggtaccgtaacggtccggttaacgaccggttaaaccggttccggggtacccgttaccggggtaccggtttacccggggaacccggtaaacggggtaacccgtaaaacgggttacgggtaaaccgtaacgttaaccggaaacgggtaccggtaaaccggttacgggtacgggtaccgtacggtaaccccgtaacccttacgtttaccgtttccgg

SEQ ID NO: 275196 - DNA, 579 bp, Homo sapiens
  misc_feature: GYAE6OF01CW56E.9.50.E06.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctccncatctatgatgcatccaacagggccactggcatcccagccaggttcagtggcagtgggtctggggacagacttcactctcaccatcagcagactagacgcctagaagtattttgacttaagtttattacttgtacagcagcgtagacctaacgtcggccgttacgggaccggttccggacccggaaacgggtaaccgtaaacggtacggaaccgtaacgtaacgaacggaaccgtaaaccgttcggtacgggtaccgtacggtacccaaccgtacgttccgttaccgg

SEQ ID NO: 275197 - DNA, 516 bp, Homo sapiens
  misc_feature: GYAE6OF01CZJXK.9.50.E06.1.454.CMB.1.raw
  modified_base (311)..(311): a, c, t, g, unknown or other
  misc_feature (311)..(311): n is a, c, g, or t
tcagtgatacgtctcacgaccggtgctcgatttagatctactgacaacacacaagggggaggaactgctcagttatgacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacngggccactggcatcccagcccaggttcagtggcaggtgggtctgggacagtacttcactctcaccatcagcagactagacgcctagaagtatttgacttagttttattacttgtcagcagctagcaacgtggcctcgggacgttcggaccgaagggaccaaggtcggacagtacgaagacgaacgtggtaggctgccactgtccg

SEQ ID NO: 275198 - DNA, 512 bp, Homo sapiens
  misc_feature: GYAE6OF01AW5FW.9.50.E06.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (506)..(506): a, c, t, g, unknown or other
  misc_feature (506)..(506): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacngggccacgtggcatcccagccaggttcagtgcagtggtctgggacagacttcactctcaccatcagcagactagacgcctagaagtatttgctagtttattactgtcagcagcgtagcaacgtggcctcgggacgttcggccgaagggaccaaagtcggaacacgtacaaggcgaacgtgtacggctacgacacngtctcg

SEQ ID NO: 275199 - DNA, 503 bp, Homo sapiens
  misc_feature: GYAE6OF01DIY0Z.9.50.E06.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctccagattccaccggagaagttgtgttgacacagtctccagccaccctgtctttgtctccgagggaaanagccacctctcctgcagggccagtcagagtcttaggagctccttagcctggtatcaacagaaacctggccaggctccaggctcctnatctatgatgcatccaagcggccactggcactccagcaggttcagtcggcaggtgggtctgggacaggtacttcgactctcactatcagcagactagacgcctagaagttatttgctaagtttactactgtcagtcagtctagcaagtcgcctggacgtcgacgtacggacaaggtgacagtcaagcgtaacgtgtgctgcacctagtcttacg

SEQ ID NO: 275200 - DNA, 537 bp, Homo sapiens
  misc_feature: GYAE6OF01DMO8J.9.50.E06.1.454.CMB.1.raw
  modified_base (204)..(204): a, c, t, g, unknown or other
  misc_feature (204)..(204): n is a, c, g, or t
  modified_base (385)..(385): a, c, t, g, unknown or other
  misc_feature (385)..(385): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaacctggccaggctcccaggcctcctcatctatgatgcatcccaacgagggccacgtggcactccccagccaggttcagtggcaggtgggtctgggacagacttcactctcacctatcancagactagacgcctagaagtattttgactagttttattacgttgtcagtcagtcgtagacaacgtcggccctcgggtaccgttcggaccgaagggaccgaaaggtcggaactacgtacgaagcgaacgtggtcgctacgaccacctgtctcg

SEQ ID NO: 275201 - DNA, 524 bp, Homo sapiens
  misc_feature: GYAE6OF01DGVJ7.9.50.E06.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (401)..(401): a, c, t, g, unknown or other
  misc_feature (401)..(401): n is a, c, g, or t
  modified_base (506)..(506): a, c, t, g, unknown or other
  misc_feature (506)..(506): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccaggggaaanagccaccctctcctgcagggccagtcagagtcttaggagctccttagcctggtatcaacagaaacctggccaggctcccaggctccnatctatgatgcatccaacngggccagtggcactcccagccaggttcagtggcaggtgggtctgggacagacttcactctcaccatcagcagactagacgcctagaagtntttgcttagtttatactgtcagcagtcgtagacaacgtggacctcgggaccgttcggaccgaagggacctaaaggtcggacgacgtagaagcgtaactgtggacncgaccgactagtcgttcg

SEQ ID NO: 275202 - DNA, 557 bp, Homo sapiens
  misc_feature: GYAE6OF01DIH1T.9.50.E06.1.454.CMB.1.raw
  modified_base (204)..(204): a, c, t, g, unknown or other
  misc_feature (204)..(204): n is a, c, g, or t
  modified_base (549)..(549): a, c, t, g, unknown or other
  misc_feature (549)..(549): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggcctcccaggcctcctcatctatgatgcatcccaacgagggccacgtggcactccccagccaggttcagtggcaggtgggtctgggacagacttcactctcaccatcagcaagactagagcctagaagtattttgacttaagttttattacttgtcagcagcgtagactaacgtcggccgttacgggtaccgttccgggaccgtaaacggggaaccgaaaggtcggaacgaacgtacgaaagcggaaacgtggtacggtctacgaccaaccngttcgtcg

SEQ ID NO: 275203 - DNA, 520 bp, Homo sapiens
  misc_feature: GYAE6OF01EF9PF.9.50.E06.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccaggggaaanagccaccctctcctgcagggccagtcagagtcttaggagctccttagcctggtatcaacagaaacctggccaggctcccaggctcctcatctatgatgcatccaacagggccagtggcatcccagccaggttcagtggcagtgggtctgggacagacttcactctcaccatcagcagactagncctagaagtatttgctagtttatactgtcagcagtcgtagactaacgtggccttcgggacgttcggaccgaagggaccgtaagtcggacagtacgaaggcgaaacgtgtacggcgtacgacctactatcgtacg

SEQ ID NO: 275204 - DNA, 552 bp, Homo sapiens
  misc_feature: GYAE6OF01DCUVO.9.50.E06.1.454.CMB.1.raw
  modified_base (415)..(415): a, c, t, g, unknown or other
  misc_feature (415)..(415): n is a, c, g, or t
  modified_base (544)..(544): a, c, t, g, unknown or other
  misc_feature (544)..(544): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggcctcccgaggcctcctcatctatgatgcatcccaacgagggcccacgtggaccactccccagccaggttcaggtggcaggtgggtctgggacagacttcactctacacatcagcagactagacgcctaggaaagttnttttgacttagttttattacttgtacagcaggtcgtagaccaacgttcggccctcgggtaccgttcggaccgtaaacgggaaccgaaaggtcggaactatacgaaggcgaacgtggtggctagccaccnttcgttcg

SEQ ID NO: 275205 - DNA, 533 bp, Homo sapiens
  misc_feature: GYAE6OF01BZSQV.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttagganctcttagccttggtatcaacagaaacctggccaggctccaggctcctcatctatgatgcatccaacagggccacgtggcatcccagcccaggttcagtggcaggtggtctgggacagacttcactctcacatcagcagactagacgcctagaagtattttgcttagtttattactgtcagctagcgtagcgtaacgtcgccgtcggacggttccggaccgaacgggacctaaaggtacggacacgtacaacggcgtaacgtggtacggctcggaccaccgtagtcgttacg

SEQ ID NO: 275206 - DNA, 758 bp, Homo sapiens
  misc_feature: GYAE6OF01AMHPA.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangccacctctcctgcagggccagtcagagtcttaggagctcttagcctggtatcaacagaaacctggccaggcctccaggcctcctcatctatgatgcatccaagcgggccatggcactcccagccagggttcaggttcggacgtaggtcggggtctacggggacacggtaccctttcgaaccttcgtaccaaccctaagtccgaacggaccgaaggtaaccgttaacggacggtaccctaaggtaaacggttacgttttttacggaccgtttaaaggttttttaactttaaccgttcggtttaccgaaacggtccgtaacgggttaccggtttaacggaacccttaaacccgggttcgggtaacccccggtttacggggttaacccgggttaccggggtaaccccggtaaaacgggggttaaccccggtaaaaaacgggttaccgggttaaacccggtaaacggttacccggaaaaccgggtaccggtaaaacggtttcgggtacgggtacccgttacgggtacccaaacccggttagttcccggtttaccgg

SEQ ID NO: 275207 - DNA, 533 bp, Homo sapiens
  misc_feature: GYAE6OF01BUD1J.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctcctagcctggtatcaacagaacctggccaggctccaggctcctcatctatgatgcatccaacaggccagtggcatccagcagttcagtgcaggtggtctgggacagacttcactctcacatcagcagactagacgtcctagaagtattttgacttagtttatactgtacagacagtcgtagcgtaacgtcggacccgtcggacgttcggaccgaacgggtaccgaaaggtacggacgtacgtacgaacgacgtacgtggtacggtcgtacgactacctagtcgttacg

SEQ ID NO: 275208 - DNA, 805 bp, Homo sapiens
  misc_feature: GYAE6OF01B71SI.9.50.E06.1.454.CMB.1.raw
  modified_base (146)..(146): a, c, t, g, unknown or other
  misc_feature (146)..(146): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
tcagtgatacgtctcacgaccggtgctcgatttagatctactgacaacacacaaggggagaactgctcagttaggacccagagggaccatggaagcccagctcagcttctcttctctgctactctggctcccagacttccacgganaagttgtgttgacacagtctcagccacctgtcttgctcagggaancgccacctntcctgcagggccagtcagtcgtctaggacgtctaccgttagccttaggtactccgaaacaggtaaaccgttggacctaagggtcccttaccgaagggtccttaccgtactaacgttccgttaagtcgtaacgttcggacctaacgtcccgaaaacggcgggtacctacgtggacctacgttccccgagtccgtaggttcaggttcgactaggtcgggtctacgggactacggtaccttacgaccttcgtaccgacctagtaccgtacggtaccgtaacgtaccgttaacgaccggttaccgttaagggtaaaccgtttacgtttttaccggaacgtttaaacggtttttaaccgtaccgttcggtttaacccgtaacggtccgttaaacgggttccggttaaacggtacccgttaaaccgggtttcccgggtaaccctttccgggggtaaccggtttacccgggaacccggttaaacggggtaaccgtaaacccggttgggtaaacccgttacgttaaccgggaaacggttacccggttaaaccgttcgggttacggtacccgtttacggaaacccgttccggttaacgtttacggttacccggg

SEQ ID NO: 275209 - DNA, 555 bp, Homo sapiens
  misc_feature: GYAE6OF01BXT3W.9.50.E06.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttagganctccttagcctggtatcaacagaaacctggccaggcctcccaggcctcctcatctatgatgacatccaacgngggccacgtggccactccccagcctaggttcaggtggctaggtgggtctgggacagtaccttcactctcaccntcagcagactagancctagtaagtatttgcttagttttacttactgtacagctagcgtagacctaacgtcggtaccgtcgggtaccgttcgggaccgaacgggaaccaaggtacggacgtacgtacgaaggccgaacgtggtcggtactcgaccacctgtcgttacg

SEQ ID NO: 275210 - DNA, 601 bp, Homo sapiens
  misc_feature: GYAE6OF01BZUU5.9.50.E06.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggcctcccgaggcctcctcatctatgatgcatccaacngggccagtcggcactcccagccctaggttcaggtcggctaggtgggtcgtggggactaggtaccttcgaccttcctaccacctataccgacgtaccaagtactaaggacgtacctaaggaacgttattttcgactttaagttttacttacgtgtacagctaaggtccgtataccgaacgtcggccgttacgggtaccgttcgggaaccgtaaacggggaaccaaagggtcgaacgacgtagaacggcgaacgtggtacggtctacggacctacctagttccgttacg

SEQ ID NO: 275211 - DNA, 535 bp, Homo sapiens
  misc_feature: GYAE6OF01B9GMS.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacgagggccactggcactcccagccaggttcagtggcaggtgggtctgggacagacttcactctcacatcagcagactagacgcctagaagtattttgacttagtttattactgtcagcagcgtagcaacgtcggacctcgggaccgttcggaccgaacgggaaccgtaaagtacggacgtacgtacgaacggcggaacgtggtacggcctagaccactgtcttacg

SEQ ID NO: 275212 - DNA, 545 bp, Homo sapiens
  misc_feature: GYAE6OF01EBKFL.9.50.E06.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (317)..(317): a, c, t, g, unknown or other
  misc_feature (317)..(317): n is a, c, g, or t
  modified_base (412)..(412): a, c, t, g, unknown or other
  misc_feature (412)..(412): n is a, c, g, or t
  modified_base (539)..(539): a, c, t, g, unknown or other
  misc_feature (539)..(539): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaancgccaccctctcctgcagggccagtcagagtcttagganctccttagcctggtatcaacagaaacctggccaggcctcccgaggcctcctcattctatgatgcatcccaacgngggccacgtcggacactcccagcctaggttcaggtggctaggtgggtctgggacacgtacttcactctcacatcagcagactagagctagaagtntttgacttagtttactactgtacacgtcgagtcgtacgacgtaacgtcggtccgtcggacgttacggaccgaacggaccgaaggtacgacgactacgacgcgaactcggtacggtctacgacctacntcgtcg

SEQ ID NO: 275213 - DNA, 532 bp, Homo sapiens
  misc_feature: GYAE6OF01B0QPF.9.50.E06.1.454.CMB.1.raw
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacgacgggccacgtggcatccccagccaggttcagtggcagtgggtctgggacagacttcactctcaccatcancagactagagacctgaatntttgctatttatactgtacagcagcgtagcaacgtcggtacctcggacgttcggacccggaaacgggaccaaaacggtggaccagtacgaagaccggaacgttgcgggtctagaccacctaagtccgtacg

SEQ ID NO: 275214 - DNA, 672 bp, Homo sapiens
  misc_feature: GYAE6OF01D5C52.9.50.E06.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccaggggaaangcccaccctctcctgcagggccagtcagagtctaggnctcttagcctggtatcaacagaaacctggccaggcctcccgaggcctcctcatctatgatgcatccaacgcgggccacgtggcactcccagccaggttcaggtgcaggtggtctgggacagtaccttcactctaccacctatcgacgacaagtaccgtaaggacgtccgttaaggtaaacgttactttttcggaccgtttaaggttttaaccgtttacgttcggttaacctaacggtaccgtaaggttaccggttaacggacccgtaaaccgttccggggtacccgttaccggggtaacccggttacccgggaacccggaaacggggtaaacccgtaaaacgggtccgggtaaaccgtaacgttaaccggaaacggtaccggtaaaccgttggtacgggccttacggaccctaaccgtcgtccgttaccg

SEQ ID NO: 275215 - DNA, 570 bp, Homo sapiens
  misc_feature: GYAE6OF01D1O4Q.9.50.E06.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (282)..(282): a, c, t, g, unknown or other
  misc_feature (282)..(282): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccagggaangccaccctctcctgcagggccagtcagagtctagganctcctagcctggtatcaacagaacctgccaggctccagctctnatctatgatgcataccaacgcgggccagtcggccacgtccccgagacccgtaggttccaggtcggcgtaggtcgggtctaggggactaggtacctttcgacttcctacaccatacgagcgagactagacgtccgtagtaagtattttgacttagtttattacgttgtacagtacaggtacgtagcgtaacgtcggtccgttacgggtacgtaccggaccgaacggacgaaacgtacggacgacgtacgaacggcgtaacgtgtacggtccgtagaccacctgtcgtcg

SEQ ID NO: 275216 - DNA, 665 bp, Homo sapiens
  misc_feature: GYAE6OF01C76EZ.9.50.E06.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctccagattccacggagaagttgtgttgacacagtctccagccacctgtcttgtctcaggggaaangccacctctcctgcagggccagtcagagtcttaggagctccttagcctggtatcaacagaaacctggaccaggcctcccaggcctcctnatctatgatgcatccaancgggccatggcactcccagccaggttcagtggcaggtgggctgggacagacttcactctacacatcagcagactagacgtacctaggaaagttacgttttagacgtttaaggttttaactttaaccgttgttaccgtaaggtaccgtaacgggtaccggttaacggaccgtaaaccggtttcgggaccccgttaccggggtaaccggtttacccgggaacccgtaaaaccggggtaaccggtaaaacggttaccggggaaaccgttaaacgtaacggtaaaccggtacccgggtaaacgtttacggggtacggtacccggttacggaccccgtaacccgttaacgttccgtttacccgg

SEQ ID NO: 275217 - DNA, 551 bp, Homo sapiens
  misc_feature: GYAE6OF01AI4UE.9.50.E06.1.454.CMB.1.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaaacctggccaggctcccaggcctcctcatctatgatgcatccaacgacgggccacgtggcactccccagccaggttcaggtggcaggtgggtctggggacaggacttcactcncaccatcagcagactagacgcctagaacgtatttgactaggtttattactgtcagccaggtcgtagctaagtcggacccttcgggtaccgttaccggaccgtaacgggacccgtaaaggtcggaactacgtacgaagccgtaacgtggtacggccgtgaccgacctgtcttcg

SEQ ID NO: 275218 - DNA, 568 bp, Homo sapiens
  misc_feature: GYAE6OF01AQUH7.9.50.E06.1.454.CMB.1.raw
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggngctccttagcctggtactcaacagaaacctggccaggctccaggcctcctcatctatgatcgcatccaacngggccactggcatcccagccaggttcagtgcagtgggtctgggacagactcactctcacatcagcagactagacgccgtagaagtattttgacgttaagttttacttacgtgtcagaccaggtcgtagctaacgtcgggaccttacggtacggttccggaccgtaacgggaccgtaaacggtacggaacgtaagttaccgaaaggacccgtaacgttacggtacggtacgtcggaccacctagttccgttaccgg

SEQ ID NO: 275219 - DNA, 543 bp, Homo sapiens
  misc_feature: GYAE6OF01DKBMH.9.50.E06.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
  modified_base (401)..(401): a, c, t, g, unknown or other
  misc_feature (401)..(401): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagcccaccctctcctgcagggccagtcagagtctagganctcctagcctggtatcaacagaaacctggccaggctccaggctcctnatctatgatgcatccaacgagggccactggcactcccagccaggttcagtggcaggtgggtctgggacagacttcactctcaccatacagcaagactagagcctagaagtntttagctagtttatactgtacagcagcgtagactaacgtggccgtcggtaccgttcgggaccgaaacgggaaccgaaaggtacggaacaacgttacaaaggacgaaacgtggtacggtctacggaccaacctagtcgttacg

SEQ ID NO: 275220 - DNA, 525 bp, Homo sapiens
  misc_feature: GYAE6OF01DJY8I.9.50.E06.1.454.CMB.1.raw
  modified_base (204)..(204): a, c, t, g, unknown or other
  misc_feature (204)..(204): n is a, c, g, or t
  modified_base (407)..(407): a, c, t, g, unknown or other
  misc_feature (407)..(407): n is a, c, g, or t
  modified_base (519)..(519): a, c, t, g, unknown or other
  misc_feature (519)..(519): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggcctcctcatctatgatgcatccaacgagggccactggcactccccagccaggttcagtggcaggtgggtctgggacaggactttcacctctcaccatcagcagactagacgcctagaagtnttttgacttagtttattactgtcagcagcgtagacaacgtcggccgtcggacgttcggaccgaagggaccaaaggtggaacgatacgaaggcgaacgtgtagctcgacaccntcgtcg

SEQ ID NO: 275221 - DNA, 555 bp, Homo sapiens
  misc_feature: GYAE6OF01D8TNK.9.50.E06.1.454.CMB.1.raw
  modified_base (206)..(206): a, c, t, g, unknown or other
  misc_feature (206)..(206): n is a, c, g, or t
  modified_base (314)..(314): a, c, t, g, unknown or other
  misc_feature (314)..(314): n is a, c, g, or t
  modified_base (399)..(399): a, c, t, g, unknown or other
  misc_feature (399)..(399): n is a, c, g, or t
  modified_base (412)..(412): a, c, t, g, unknown or other
  misc_feature (412)..(412): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaanagcccaccctctcctgcagggccagtcagagtcttaggagctccttagcctggtatcaacagaaacctggccaggcctccaggctcctcatctatgatgcatccaacngggccacgtggcactcccagcctaggttcaggtggcgaggtgggtcgtgggacaggtacttcactctacacatcagcagactagngtcctagaagttntttgacttagttttacttacgtgtcagcagtcgtagccaagttcggccttacgggacgttaccgggaccgtaacgggaaccaaagggtcggaacacgtacgaacggcgaacgtggtacggcgtacgacaccctgttcgttacg

SEQ ID NO: 275222 - DNA, 510 bp, Homo sapiens
  misc_feature: GYAE6OF01B84J3.9.50.E06.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (503)..(503): a, c, t, g, unknown or other
  misc_feature (503)..(503): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacngggccatggcatcccagccaggttcagtgcagtgggtctgggacagacttcactctcacatcagcagactagagcctagaagtattttgacggttttatacgtgtcagtcagtcgtagcaacgtggcctcggacgttcggaccaagggacctaaaggtcggaacagtacgaagcgaactggtgctgacaccntctgtcc

SEQ ID NO: 275223 - DNA, 673 bp, Homo sapiens
  misc_feature: GYAE6OF01DJ0A9.9.50.E06.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaancgccaccctctcctgcagggccagtcagagtcttagganctcttagcctggtatcaacagaacctggccaggctccaggcctcctcatctatcgatgcataccaacgacgggccacgtggacactccccgagtcccgaaggttccaggtcggctaggtcgggtctaggggactacggtacctttcaacctctaccaacctactacgaacgcaaaggtactaaacggacgtaccgtaaggtaagtttacgttttaggacttaaggttttacttactgtacgtacgcgtaggtaccgtagaccgtaaccgtcgggtacccttaccggggtacgtttacccgggaaccggtaaaaccggggtaaccgaaacgggttacggaaaccgtaacgttaaccgaaacggttacccggtaaaacggttcggtacgggtaccgttaccgggacctaacccgttagttcccgttaccgg

SEQ ID NO: 275224 - DNA, 554 bp, Homo sapiens
  misc_feature: GYAE6OF01A1TRX.9.50.E06.1.454.CMB.1.raw
  modified_base (206)..(206): a, c, t, g, unknown or other
  misc_feature (206)..(206): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaanagcccaccctctcctgcagggccagtcagagtcttaggagctccttagcctggtatcaacagaaacctggccaggctccaggctcctcatctatgatgcactccaacgcgggccacgtggcactcccagcctaggttcaggtggcaggtgggtcgtgggacagtacttcactctcaccatcagcagactagacgcctagaagtatttgacttagtttatacgtgtcagtcgagtcgtagactacgtcggacctcgggtacgttaccggaccgaacgggaccaaaggtcggaactacgtacgaacggtccgtaacgtggtacggtccgtagaccctacgtattcgtacg

SEQ ID NO: 275225 - DNA, 515 bp, Homo sapiens
  misc_feature: GYAE6OF01B273A.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (375)..(375): a, c, t, g, unknown or other
  misc_feature (375)..(375): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggngctccttagcctggtatcaacagaaacctggccaggcctcccaggctcctcatctatgatgcatccaacgagggccacgtggccatccccagccaggttcagtggcaggtgggtctgggacagacttcactcncacatcagcagactagacgcctagaagtattttgacttagtttattactgtacagcagcgtagcaacgtcggacctcggacgtcggaccgaaggaccaaggtgacgatacaaggcgacgtgtcggcngacactntcgtcg

SEQ ID NO: 275226 - DNA, 547 bp, Homo sapiens
  misc_feature: GYAE6OF01A3LMK.9.50.E06.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagcccaccctctcctgcagggccagtcagagtcttaggagctccttagcctggtatcaacagaacctggccaggcctcccaggctcctcatctatgatgcatcccaacgngggccacgtggcactccccagccaggttcaggtggcaggtcgggtcgtggggacagtacttcactctccaccatcagcagactagacgctagaagtatttgactagtttattactgtcagcgtagcgtagctaacgtcggtccgtcggtaccggttccggaccgaacgggaccgaaaggtcggaacgtacgtacgaacggcgaacgtggtcggctagaccnccgnttcgtacg

SEQ ID NO: 275227 - DNA, 539 bp, Homo sapiens
  misc_feature: GYAE6OF01ARCV6.9.50.E06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (308)..(308): a, c, t, g, unknown or other
  misc_feature (308)..(308): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccacctntcctgcagggccagtcagagtcttaggagctccttagcctggtactcaacagaaacctggccaggctcccaggctcctcatcatgatgcatccaangggccatggcatcccagccaggttcagtcggcaggtggtctgggacaggtacttcacgtctacaccatcagcagactagagcctgaagtatttgctagtttatactgtcagcagtcgtagctaacgtggcctacggacgttcggaccgaacgggacctaaaggtcggaacgtcgtacgaacggtccgtaacgtcggtacggtactacgacctaaccctagttccgttacgg

SEQ ID NO: 275228 - DNA, 540 bp, Homo sapiens
  misc_feature: GYAE6OF01D83P6.9.50.E06.1.454.CMB.1.raw
  modified_base (206)..(206): a, c, t, g, unknown or other
  misc_feature (206)..(206): n is a, c, g, or t
  modified_base (407)..(407): a, c, t, g, unknown or other
  misc_feature (407)..(407): n is a, c, g, or t
tcagtgatacgtctcacgaccggtgctcgatttagatctactgacaacacacaaggggggaggaactgctcagttaggacccagagggaaccatggaagccccagctctagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctccaggcctcctcatctatgatgcatccaacgagggcccactggcactcccagccaggttcagtgcagtggatcgtgggacagtacttcactcctacaccatcagcagactagacgcctagaagtnttttgacttagtttattactgtacagtcagacgtagacacgtcggccgtcggaccgttcggaccgaacgggacctaaaggtcggaacagtacgaaggacgtaacgtggtacggactaggacctacctagtccg

SEQ ID NO: 275229 - DNA, 611 bp, Homo sapiens
  misc_feature: GYAE6OF01BX9DO.9.50.E06.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggngctcttagcctggtatcaacagaaacctggccaggcctccaggctcctcatctatgatgcatccaagngggccacgtgcactcccagcctaggttcagtcggctagtcgggtctgggactagtacttcgactcgtacacctatccagcaacgtacgtaagacgtcctagaaacgttagttttcgaccttaaggtttttataaccgttggtacctaaggtcctaaggtaccgttacgactaaaccgttcgggacccttacgggtaaccggtttccgggaaccgtaaacggggaacctaaacgggtcggaacgtactacgaaacggccgtaaacgttggtacgggtctacggaccaacctagttcttaccgg

SEQ ID NO: 275230 - DNA, 539 bp, Homo sapiens
  misc_feature: GYAE6OF01EC7YM.9.50.E06.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccaccctctcctgcagggccagtcagagtcttaggngctccttagcctggtatcaacagaacctggccaggctcccaggcctcctcatctatgatgcatccaacgcgggccacgtggcactcccagccaggttcagtgcagtgggtctgggacagacttcactctcacatcagcagactagacgtcctagaagtattttgacttagtttacttacgttgtcagcagcgtagctacgtcggtaccgtcggacgttcggaccgaacgggaccgaaaggtcggacgtagtacgaacggtcgaaacgtggtacggtctacgacctacctgtcgttacg

SEQ ID NO: 275231 - DNA, 688 bp, Homo sapiens
  misc_feature: GYAE6OF01C9JPY.9.50.E06.1.454.CMB.1.raw
  modified_base (484)..(484): a, c, t, g, unknown or other
  misc_feature (484)..(484): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaagagccaccctctcctgcagggccagtcagagtcttaggagctccttagcctggtactacaacaagaaaccgtggacccaaggcctcccgaggcctcctcatctatgatgcactacccaacgacgggcctaaccgtgggaccactacccccgaggcccgaacggtttcaacggttcgggacgtagggttcggggtactaggggaccacggtaccgtttaccaccttcctaccaacctacgtacaacgcaagtaacgtaacgacgtacctaggtaaacgtntttttacgacgtttaacggttttaacttacgtcggttacacggtactacggtacgtaacgaccgtaacgtccggtacccgttacgggtaccgtttaccggaacccggtaaacgggaaaccgtaaaacggtacgggaacgtaacgttaacgaacgacggtaaccgtaggttacggtactacgaccgtaaacctcgttccgttacg

SEQ ID NO: 275232 - DNA, 617 bp, Homo sapiens
  misc_feature: GYAE6OF01BMKL7.9.50.E06.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (291)..(291): a, c, t, g, unknown or other
  misc_feature (291)..(291): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgctccgaggggaaangccacctntcctgcagggccagtcagagtcttaggagctccttagcctggtatcaacagaacctggccaggcctcccgaggcctcctnatctatgatgcatccaagcgggccacgtggccactcccagccaggttcaggtcggcaggtgggtctgggacaggtacttcgactctacactatcagcagactagacgtacctaggtaagttattttcgacttaggttttacttacgtcgtactagcctaaggtcgtaagcctaacggtcggtacccgttacgggtaccggttaccggaaccggtaacggggaaaccgtaaacgggtacggaacgtaacggtaccgtaaacgggtccggtaaacgttcgggtaccgggtaccgtacggacccgaacccgttaagttcccgtttacgg

SEQ ID NO: 275233 - DNA, 856 bp, Homo sapiens
  misc_feature: GYAE6OF01C0HD4.9.50.E06.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaanacgccaccctctcctgcagggccagtcagagtcttaggnctccttagcctggtatcaacagaacctggccaggctcccaggctcctcatctatcgatgacatacccaaacgacggggccctaacgtcgggcctaactcccccgaggcccgtaaaggggttttccaagggttcgggaccgtaaggggttcgggggttaccgttacggggggaacctacgggtaaccctttttcgaaaccccgttttccgttaacccgaaaccccttaagttacccgaaacgggtacccgaaacgggtaaacccgttaaacggggaacggtaccccggtttaaagggtaaaacgggtttaacgtttttttacgggtaacccgttttaaacgggttttttaaacttttaaccgtttacggtttaaccgtaacggtaccgttaacgggtaccggtttaacggtaacccgttaaaccggttcggggtaccccgttacccggggttaacccggttttacccggggaacccgtaaaacgggggtaaaccccggtaaaaagggttaccgggaaaccgtaacggttaaccgaaacggtaaccgggtaaaccgtttacgggttacgggtacccgttacggacccgtaacccgttacgttccgtttaccgg

SEQ ID NO: 275234 - DNA, 689 bp, Homo sapiens
  misc_feature: GYAE6OF01D0K68.9.50.E06.1.454.CMB.1.raw
  modified_base (207)..(207): a, c, t, g, unknown or other
  misc_feature (207)..(207): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagattccaccggagaagttggtgttgacacagtctccagccaccctgtctttgtctccgaggggaaanagccaccctctcctgcagggccagtcagagtcttaggagctccttagcctggtactacaacaagaaacctggccaggcctccaggcctctcattctatcgatgcatccaacgagggccacgtggcactccccagcctaggttcaggtacggcgaggttggggtcgtggggacacggtacctttcaccttcgtaccacctactacgaacgcaaacgtactaaacgggacgtccgtaaggtaaagttcgttttgacgtttaaaggttttactttacggttagtcgtaacggtccgtacggtacggttaacgaccgtaaaccggttcgggtaccccgttacggggttaaccgggtttaccgggaacccggtaaaaccggggtaaacccgtaaaagggtttccgggaaacgtaaccggtacggtaaacgggtcggtaaaaccgtgggttaccgggtctaccggtaccaaccgtacgttccggttcg

SEQ ID NO: 275235 - DNA, 715 bp, Homo sapiens
  misc_feature: GYAE6OF01BK9MT.9.50.E06.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
tcagtgatacgtctcacgaccggtgctcgatttagatctactgacaacacacaagggggaggaactgctcagttaggacccagagggaaccatggaagcccagctcagcttctcttcctcctgctactctggctccagattccaccggagaagttgtgttgacacagtctccagccacctgtctttgctccgaggggaancgccaccctctcctgcgagggccagtcagagtcttaggntctccttagcctggtactcaacagaaacctggccaggcctccgaggtcctcctcatctatgactgacctatacccgaaacgcgggacccagtcggacctacgtccccaggcccgtaggttcaggttgggactagggtcgggtacgtaggggaactacggtacctttccgacttccgtaccaaccgtagtaccaggacctaacggtacctaaggacgtaccgtagtaaagttacgttttcgacgtttaagtttacttacgtggttaccgagtaccgacggtcgtaacggtaccgtaaccggttcgggtacccgttaccggggtacccggttaccgggaaacccggtaaacggggtaacccgtaaacggggttaacggtaacccgtaaggttaacccggaaacgggttaacccggtaacggttccgggttaacgggtaccgtaccggaaccctaacccgttaagtttccggttacccg

SEQ ID NO: 275236 - DNA, 696 bp, Homo sapiens
  misc_feature: GYAE6OF01E1YP3.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaagagccaccctctcctgcagggccagtcagagtcttaggagctccttagcctggtatcaacagaaacctggccaggcctcccgaggcctcctcatctatgatcgcatccaacgacgggccacgtcggacacgtccccagcccgtacggttcacggttgggcgtagggttcggggtcgtacggggaactagtaccttccaacttcctaccgaacctatccgaacggccaagtaccgtaggacgtaccgttaggaacgtttagttttcgactttaagtttttaacttacgtttggtaccgtaaggtccgtaacggtcggttaacgaccgtaaaccgttccgggtaccccgttacggggtaaccgtttacccgggaaccggtaaaacggggtaacccgtaaaacggggtacggtaaaccgtacgtaaccgaaacgggtacccgtaaacggttggtaccgggtcgttaccgaccgacccgtaagttcccggtttacg

SEQ ID NO: 275237 - DNA, 763 bp, Homo sapiens
  misc_feature: GYAE6OF01BVF7C.9.50.E06.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctccagattccaccggagaagttgtgttgacacagtctccagccacctgtctttgctcgagggaancgccacctctctgcaggccagtcagagtctaggnctccttagcctggtactacaacaacgaaacctggaccaggtcctcccgaggtcctcctctactctatgatcgcactacccgaaacgcgggaccacgtcggacctaccgtaccccgacggacccgtaaggggtttaccaggtcgggcgtaagggttcggggtacgtacggggaactacggtacctttcaccgttcctaccgaacctacgtccgaacggtacaacggtaacgtaacggacggtaccgttaaggtaaagtttacgttttttacggaaccgttttaagtttttaacgtttaccgtttacggtaaccgtacgggtccgtaacgggtaccgttaaacgaccccggttaaacggttcccggggtaaccccgttaccggggtaacccggttccggggaacccggtaaaacggggtaacccgtaaaacgggttcggaaaccgtacttaaccgggaaacggtaaccgggtaacggttacgggttacggtaccggtacgtacccaaccggttaccgttccccggtttaccc

SEQ ID NO: 275238 - DNA, 579 bp, Homo sapiens
  misc_feature: GYAE6OF01EP1RQ.9.50.E06.1.454.CMB.1.raw
  modified_base (290)..(290): a, c, t, g, unknown or other
  misc_feature (290)..(290): n is a, c, g, or t
tcagtgatacgtctcacgaccggtgctcgatttagatctactgacaacacacaagggtgaggaactgctcagttaggacccagagggaaccatggaagccccagctcagcttctcttcctcctgctactctggctcccagattccaccggagaagttgtgttgacacagtctccagccaccctgtctttgctccgaggggaaagagccaccctctcctgcagggccagtcagagtcttaggagctccttagcctggtatcaacagaaacctggccaggctccaggctccncatctatgatgcataccaacgacgggccacgtggccaactcccagccaaggttccaaggtggactaggtgggtctgggacagactttcactctacacctatcagcagactagagtacctgaacgttattttgacttaggttttaattacgtagttacagctaggtacggtagaccgtaacgttcgggccctacgggacgttccggaacgaacgggtaaccgaaaggttacggactaataccgaaagaacgtaacgttacggtacggacgtaggacctaaccgagttccg

SEQ ID NO: 275239 - DNA, 545 bp, Homo sapiens
  misc_feature: GYAE6OF01EZ2XG.9.50.E06.1.454.CMB.1.raw
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagatttccaccggagaagttgtgttgacacagtctccagccaccctgtctttgtctccaggggaaancgcccaccctctcctgccagggccagtcagagtcttaggntctccttagcctggtatcaacagaaacctggccaggctccaggctcctcatctatgatgccatccaacgcgggccactgggcactcccagccaggttccaggtgcgaggtgggtctggggactaggtacttcgactctcaccatcagcagactagagctagaagtatttgcttagtttatactgtacagtcagtcgtagactacgtggcctgggaccggttcgaccgaacgggtacaaacggtcggaactacgtacgaaaggccgtaaacgtggtacgtcgtcacgtaccactcgttacg

SEQ ID NO: 275240 - DNA, 571 bp, Homo sapiens
  misc_feature: GYAE6OF01EU6G9.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagcccaccctctcctgcagggccagtcagagtcttaggagctcctagcctggtatcaacagaaacctggccaggctccgaggcctcctcatctatgatgcatcccaacgacgggccacgtggaccactccccgagcctaggttcaggtggctaggtgggtctgggaactaggtactcactctcaccatcacgcagactagacgtccgtagtaagtatttgacgttagtttattactgtacagtcagtcgtacgacgtacgtcggtccgtacgggtaccggttacggaccgtaacggtaccgtaaaggtaggacgtaacgtacgaacgacgtaaccgtggtacggtactcgacacctgttccgtacg

SEQ ID NO: 275241 - DNA, 585 bp, Homo sapiens
  misc_feature: GYAE6OF01CU5DC.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgaaacagtctccagccaccctgtcttgtctccaggggaaagagccaccctctcctgcagggccagtcagagtcttaggagctccttagcctggtactcaacagaaacctggccaggctcccgaggctcctcatctatgatgcatacccaacacgggcctacgtggcactcccaggcccaggttcaggtcggactaggtgggtctggggacaggtacctcgacctctccaccactcagcagactagacgcctagaagtattttagctagtttattactgtacagcagtgtacgactaacgtcggtcctacgggtacgttaccggaccggtaacgggaaccgtaaacggtacgaacgtacgtaaccgaagaccggtaaacgtacgggtaggtcgtacgaccaccctacttccgttcggtttaccc

SEQ ID NO: 275242 - DNA, 522 bp, Homo sapiens
  misc_feature: GYAE6OF01EEDB1.9.50.E06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctntcctgcagggccagtcagagtcttaggngctccttagcctggtatcaacagaaacctggccaggctccaggctcctcatctatgatgcatccaacngggccactggcatccagccaggttcagtgcagtgggtctgggacagacttcactctcaccatcagcagactagagcctagaagtattttgcttaagtttattactgtcagcagcgtagcaacgtggccttcggacgttcggaccgaagggacctaaaggtcggaacgagtacaacggcgtaacgtggtcggtctacgacacctgtcgttacg

SEQ ID NO: 275243 - DNA, 680 bp, Homo sapiens
  misc_feature: GYAE6OF01CH81Y.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttagganctccttagcctggtatcaacagaaacctggccaggcctcccaggcctcctcatctatgatgcatccaacngggccacgtggcactcccagccctaggttcagtggcaggtgggtctgggacagtactcactctcacatcgagcagtactagacgtcctaggaagttagttttcgacgtttaagttttaacgttaaccgttggttacctaaggtaccgtaggtacccgttaacggaccgtaaaccggttccgggtacccggtttacccggggtaacccgggttttacccgggaaaccccggtaaaccgggggtaaaccccgtaaaagggttccggggtaaaccgtaacggttaaccccggaaagggtaccccgggtaaaccgttacgggtacgggtacccgttacggaacccccgtaaccgtacgttcccggttacccg

SEQ ID NO: 275244 - DNA, 683 bp, Homo sapiens
  misc_feature: GYAE6OF01C3T83.9.50.E06.1.454.CMB.1.raw
  modified_base (204)..(204): a, c, t, g, unknown or other
  misc_feature (204)..(204): n is a, c, g, or t
  modified_base (521)..(521): a, c, t, g, unknown or other
  misc_feature (521)..(521): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccgaggggaaancgccaccctctcctgcgagggccagtcagagtcgttaggagtctcttagccttaggtataccaacaacgaaacctggacccgaaggcctacccgaggcctcctcacttctagtgatcgacactaccaacgacgggccacgtcggaccactcccgacgtccgtaggttcgaggttcggacgtagggttgggtcgtacgggactacggtaccttcaccgtctaccgaactactacgacgtacgaacgtacgtacggacggtacctaaggtaaaacgttgttttacgacgttttaacgttttaacttacgttccggttanaacggtacgtaacggaaccgttacgtaccgtaaccggtcgggttacccggttaccggaccggtttccggggaaaccgtaaccggggaaccgtaaaggtcggaaactacgtacgaaacggtccgaacgttgaccggtacaccgacgtacctcgttgttacccg

SEQ ID NO: 275245 - DNA, 603 bp, Homo sapiens
  misc_feature: GYAE6OF01EMOU3.9.50.E06.1.454.CMB.1.raw
  modified_base (205)..(205): a, c, t, g, unknown or other
  misc_feature (205)..(205): n is a, c, g, or t
  modified_base (577)..(577): a, c, t, g, unknown or other
  misc_feature (577)..(577): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaancgccaccctctcctgcagggccagtcagagtcttaggagctccttagcctggtatcaacagaaacctggccaggcctccgaggcctcctcactctatgatcgcactccaacgagggccacgtcggacactccccgagccgtacggttcaggtcggactaggtcgggtcgtggggactaggtaccttcgactctacaccgtactcacgtcaacgtactagacgtccgtaggaacgttagttttcgacgtttagttttattacgtcgttcacgtcaggtctacgacgtacgttacggccgtaccgggtacgttaccggaccggaaaggaacccgtaaggtaacggtacgtacgtacgaaggtccgaacgtcggnggtccacgactacctgttcccgtacg

SEQ ID NO: 275246 - DNA, 579 bp, Homo sapiens
  misc_feature: GYAE6OF01BA340.9.50.E06.1.454.CMB.1.raw
  modified_base (206)..(206): a, c, t, g, unknown or other
  misc_feature (206)..(206): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaangccaccctctcctgcagggccagtcagagtcttaggagctccttagcctggtatcaacagaaacctggaccaggcctcccgaggcctcctcatctatgatgcactccaacgcgggccacgtggccactccccgaagcccgtaggttcgaggttggctagggtgggtcgtgggacaggtactttcactctacaccatcagcagactagacgtctagaacgttatttcgacttaagtttattacgtgtacgagtcagtcgtaacacgtaacgtcggaccgttacgggacgttccggaaccgtaacgggaccgtaaaggtcgaacgtagtaccgaaggtcgtacgtaggcggctacggacctaccgtgtccgttcg

SEQ ID NO: 275247 - DNA, 588 bp, Homo sapiens
  misc_feature: GYAE6OF01DIKHW.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggnctcctagcctggtatcaacagaaacctggccaggcctcccgaggcctcctcatctatgatgcatccaacgacgggccacgtggccactcccagccaggttcaggtggcaggtgggtctgggacagtacttcactctcacatcagcaacgactaagacgtcctagaagttagttttcgacttaagtttacttacgttgtactacgcacggtacgttagacctaacgttcggacccgttacggtaccggttccggaccgaaacgggtaaccgaaacggtagggaacctaacgtacgaaaggaccggtaacgtaggtacgggacgtacgacccaccctagtccgttacg

SEQ ID NO: 275248 - DNA, 732 bp, Homo sapiens
  misc_feature: GYAE6OF01CBWG7.9.50.E06.1.454.CMB.1.raw
  modified_base (206)..(206): a, c, t, g, unknown or other
  misc_feature (206)..(206): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagccaccctctcctgcagggccagtcagatcttaggagctccttagcctggtatcaacagaaacctggaccaggcctcccgaggcctccccatctatgatgcactacccaacgacgggccacgtcggaccactccccgagcccgaggttccgaggtcggcgtagggtcggggtcgtggggaacacggtacttccgacttcctaccaacctataccgacgtaccgaagtaaccgtagacgtacccgtagtaacgttattttcgactttaaggttttaacttacgttgtactacggtacgtaacggtcggttaacgtacctaaccggttcgggttacccggttaccggggttaaccgggtttaccccggggaacccgtaaaaccggggggtaaacccgtaaaacggggtcgggtaaaacctaccggtaaccggtaaaaccggaccgggttaaaaccggttcggggttaaccggtacccggttacggtaacccgtaaacccctaccggtttccttccgggtttaacccc

SEQ ID NO: 275249 - DNA, 596 bp, Homo sapiens
  misc_feature: GYAE6OF01D83B9.9.50.E06.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccacccttgtctttgctccgaggggaaanagcccaccctctcctgcagggccagtcagagtctagganctccttagcctggtatacaacagaaacctggccaggcctcccgaggcctcctcatctatgatgcactcccaacgcgggcccacgtggaccactaccccagcctaggttcaggtggcgaggttgggtcgtaggggacaggtaccttcactctaccactatccaagcaagacgtagacgctagtaagttgttttcgacttagtttacttactgtacagtcagtacgtagaccgtaacgtcggaccgtacggtacgtccgggaaccgtaaacgggaaccgtaaaggtacggaacgtacgtaacgaacggaccgaacgtcggtacggtacgtacgacctaccgtagtccgttacg

SEQ ID NO: 275250 - DNA, 736 bp, Homo sapiens
  misc_feature: GYAE6OF01CE79H.9.50.E06.1.454.CMB.1.raw
tcagtgatacgtctcacgaccggtgctcgatttagatctactgacaacacacaaggggggaggaactgctcagttaggacccagagggaaccatggaagccccagctcagcttctcttcctcctgctactctggcctcccagattccaccgggagtaagttgtgttgacacagtctccagcccacccttgttctttgtcctccggaaggggaaacgacgcccaccctcctccgtgcgacgggccaggccagtacgttcgtaagggactccttccgtagccgttggtactacgaacgaacgtaaaccgtcgaccgacggccctaccgacggtcccttcctactactctagtgagtcgaccaactacccgaacggacgggcccacggtccggactaccgtcccgacggccgttaacgtcggtacgtcgggccgtagggttcgggtcggtacgggtaactacggtaccttacaccttccgttaacccgaacgtacgtaccgaacgtaccgtaacgtaactaacgggtacgtaccgtaaggttaaacgttgttttacgacgttttaagtttaacttcgtcgtacacgacgtacgtacgtacgaccgtacggttccggacccggttcggtaccggttaccggaaccggaaacgggtaaaccgtaaagggtacccgaaactaccggtaaccaagggtaccggaagttcggacggtcgaccgtacacgtcgttccggttaccg

SEQ ID NO: 275251 - DNA, 756 bp, Homo sapiens
  misc_feature: GYAE6OF01ATA6F.9.50.E06.1.454.CMB.1.raw
  modified_base (206)..(206): a, c, t, g, unknown or other
  misc_feature (206)..(206): n is a, c, g, or t
  modified_base (445)..(445): a, c, t, g, unknown or other
  misc_feature (445)..(445): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaangcccaccctctcctgcaggggcccagtcagagtcttaggagctcttagcctggtatcaacacgaaacctggccaggtcctcccgaggcctcctctatcctatggatcgcaatcccgaaacgacgggcccacgtggaccactaccccgagacccgtaggtttacagggttcggccgtagggttcggggtacgtacggggtaaccaacggttaccctttacgaccttccctacgaaccctntccaaggacctaacggtaacgtaacggaccggtaccgttaaggtaacggttaagtttttcggaacgtttaacgtttttaacgtttaccgttaggttacctaacggtcgtaaacggtccggtaacgtcccgtaaaccggttcgggaccccggttacgggtaacccgggtttacccggggaacccggtaaacggggtaaaccgaaaggggttaccggaaccggtaacgttacccggaaaacggcccgggttaaacgttcgggttaaccgggttaccgtaccggtaccctaacccgttagttcccggtttaccg

SEQ ID NO: 275252 - DNA, 781 bp, Homo sapiens
  misc_feature: GYAE6OF01AQKBP.9.50.E06.1.454.CMB.1.raw
  modified_base (217)..(217): a, c, t, g, unknown or other
  misc_feature (217)..(217): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagacttccgaccggagtaagttgtgttgacacagtctccagccctaccctgttctttgtcctaccggaaggggaaacncgccctacccttcgtcctggcgacgggccagtcagtgtcgttaggcgtcttccttagccgttaggtactacaacgaacgtaaaccgtcggacccaggcctacccgacggtccttacccgtactacttcctagtacgtacgttcgacctaacgtacccgaaacggaccggacctacgtcgtacctaccgtcccggaccgtaccggtagggtttacccgagggttccggggtaccgtacgggggtttcgggttacccgggtacgggggttaaacctaacggggtttacccctttaccgtaccccttttaccgacccgaacccttaccgtaccggtaaccgtacggtaaccggtaacgttaaccgggacccggttacgtaacgggttacgttttaaacgtttccgggtaactttttacggtttaacttcggttaactacggactacggtacgtcgtaacgacgtaccgtcgtccggtacgtaccggtaccgaacggtaacggactaaggtcgaacgtacgacgacggtcgacggttaggccgcgtaccacggtacctgtacgttccg

SEQ ID NO: 275253 - DNA, 667 bp, Homo sapiens
  misc_feature: GYAE6OF01CGZGZ.9.50.E06.1.454.CMB.1.raw
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
  modified_base (651)..(651): a, c, t, g, unknown or other
  misc_feature (651)..(651): n is a, c, g, or t
tcagtgatacgtctcacgaccggtgctcgatttagatctactgacaacacacaagggggaggaactgctcagttaggacccagagggaaccatggaagccccagctcagcttctcctcctcctgctactctggcctcccagacttccaccggagaagttgtgttgacacagtctccagccaccctgtctttgcctccgaggggaaacncgccaccctctccgtgcgagggccagtcagtagtctaggntcctctagccgtaggtatacaacgagaaaccgtggaccaggtcctcccgaggtccctccgtcattacctagtcgtatcgacctaactaccgaacggacgggcctaacgtcggacctaccgtccccgaacgtccgtacggtttacacggttcggacgtagggttcgggtaccgtagggacctacgtaccgtcctaaccgtcgtacccactacgtaccgtaacgaccgtacggaaccgttagggaaccgtacccgttagtaaaaggtttcgttttaacgaccgttttaagttttaccgtagtacgtcgacgtagacgtacgtacgacctacgggtcgtaccgtcggtaccggtcgaaccgaacggtaacaagtgaacactacgaggtaaccgagtcgtggacgtnccgaactgttcgtacg

SEQ ID NO: 275254 - DNA, 699 bp, Homo sapiens
  misc_feature: GYAE6OF01C5SW6.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgctcgaaggggaaancgccacctctcctgcagggccagtcagagtcgtaggatctaccgtagcctggtactacaacaagaaaccgtggacccgaaggccctcccgaacggtccttcccgtactattacctagtgtactgacctactacccgaaacggacgggccctaacgtcggacctaccgtacccgacgtaccgtaggttaccgaggtcggacgtagggttcgggtacgttaggggaacctacggttaccttccgaacttcctaaccacctaagtaccgaacgtacgaacgtacgtaagacggtactaaggtaagtttcgtttaggaccttttaaaggtttacttacgttaggtaccagtacgtaacggtccgtaaggaccctaacgggtccggtacccgttacggggtaccgtacgggaaaccggtaacggtactaaagggtcggaactaacggtagaacgggcttaaacggtggacgtacgtacgtaccacgttactggttacccg

SEQ ID NO: 275255 - DNA, 690 bp, Homo sapiens
  misc_feature: GYAE6OF01DGL6I.9.50.E06.1.454.CMB.1.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
  modified_base (657)..(657): a, c, t, g, unknown or other
  misc_feature (657)..(657): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtcttgctcgagggaanagccacctctcctgcagggccagtcagagtcttaggacnctccgtagcctggtactcgaaacagaaaccgtggaccaaggccttcccgaggtcctccctnacttacctatggaactcgctactaccaaacggcgggacccaagttcgggcctaactaccccgagacccgtaggggtttaccaaggtcggacctagggtcgggtacctaggggaactaaggtaccctttcgaccttaccgtaccaaccctataccgaacgtacgaacggtaacttaacggacgtacccgttaagggtaaaacgttagtttttacgacgtttaacggttttaaactttaacgtttacggttacgaacgtacgtaacggtacgtaacgtaaccgtacgtcggtacccgtcggtaaccggttccggaacgaacggaaccgtaaagacgacgtaactagaacggacgtaacgnggtacggtacgacgtacacctagtccgttaacg

SEQ ID NO: 275256 - DNA, 562 bp, Homo sapiens
  misc_feature: GYAE6OF01AVYBP.9.50.E06.1.454.CMB.1.raw
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
  modified_base (468)..(468): a, c, t, g, unknown or other
  misc_feature (468)..(468): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagtctccttagccttgggtactccaaacagaaacctggccaggcctcccgaggcctccctnatctaatgatcgcatccaacgacgggccagtcggcactccccgaggcccaggttcaaggtcggacaggtcggggtctagggaccagacctttcacttctccaactntcagcagactagacgactgaagtntttgacgtagtttatacgttgtcagtcagtcgtanccgaagtcgccttcggtacgtccggacgaacggacgtaaaacgtggaacgtatacaacggaccaagttcggaggtctacgactacagttcgtcg

SEQ ID NO: 275257 - DNA, 783 bp, Homo sapiens
  misc_feature: GYAE6OF01ATSN4.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccgaggggaaangccaccctctcctgcgagggccagtcagagtcttaggngtcctcctaggcctggtactcaacacgaaaccgtggccgaggcctacccgaggtcctcctcactctatgacgtcgactactacccgaacgtaccgggcccacgtggacctaccgtccccgaaggcccgttaaggttccgtagggtcggacggtagggttcggggttcggtacggggaactacggttaccttccgtaaccgtcctaaccgtacccagttaccggaacgtaccgtaagtaacccgtaagggtaccgtaacccgttaagggtaaacttttacggtttacgtaccgttaaaggtttttactttaaccgtttcggttaacgaacggtccgttaaggacccggttaaggtaccgtaaccgggttccggtacccgggttaccgggtacggtttacccgggacccgggtaaaaccggggttaaacccaaagggttaaccgggtaaacgtaacggtaacccgtaaagggtacccgtaacgggttacggttacgggtacccttacggacccgttaaacccgtaccggtttcgtttacccgg

SEQ ID NO: 275258 - DNA, 671 bp, Homo sapiens
  misc_feature: GYAE6OF01BRKH4.9.50.E06.1.454.CMB.1.raw
  modified_base (206)..(206): a, c, t, g, unknown or other
  misc_feature (206)..(206): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctccagccaccctgtctttgtctccgaggggaaanacgcccaccctctcctgcgagggccagtcagagtcttaggagctcttagcctggtatcaacagaaacctggccaggcctccgaggctccgtcatctatgatgcactaccaacgacgggccacgtggacactcccagccgtaggttcaggtcggctacgggttgggtcgtggggaaccagtacttcaacctctccacctatcacgactacgactagacgtacgtagaagttatttgacgtttaagttttacttacgttcgtactagtaccgtaacggtcgtaacgtacgtaaccggtcgggtacccggttacccggggtaacggttacccggggtaaaccccgggtaaacgggtaaacccggtaaaacgggttacgggtaaccgtacgtaaccgggtaaaccggtacgggtaaccgttgggtacgggtaccgttacgtaacccgtaacgtccgttcggttacccgg

SEQ ID NO: 275259 - DNA, 858 bp, Homo sapiens
  misc_feature: GYAE6OF01DIOAA.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggcctcccagattccaccggagaagttgtgttgacacagtctccagcccaccctgtctttgtctccgaggggaaacgacgcccaccctctcctgcgagggccagtcagagtcgtaggagcttcctagccgtggtactacaacaacgaaaccgtggacccgacggtcctcccgaggcctcctacacttactatagatcgactactacccgaacgacgggaccacgtcggaccacctccccgagccgtaggttcgaggtcggacgtagggttcggggtacgtcggggaactacggtacctttaccaccgttcctaccgaactacgtaccgacgtaccgaaagtacggtaacggacgtccgttaagggtaaacgtttcgttttacgggaacctttttaaacgggtttttaacctttaccggtttaacggttacccggtaacgggtaccgtaacgggttaacccggtttaacgggtaacccccgttaaaccgggttcccggggttaccccccggtttaacccggggggttaaccccgggtttacccccgggggaaaacccggggtaaaacccgggggttaaaacccggtaaaacgggggttccgggtaaaacccgtaaaacgggtacccggtaaaaaccggggttaccccggttaaaaccgggtttggggtacccgggttacccgtaaccgggtaccccggtaacccttacggtttcccggttttaccggg

SEQ ID NO: 275260 - DNA, 803 bp, Homo sapiens
  misc_feature: GYAE6OF01DTFYL.9.50.E06.1.454.CMB.1.raw
  modified_base (188)..(188): a, c, t, g, unknown or other
  misc_feature (188)..(188): n is a, c, g, or t
  modified_base (217)..(217): a, c, t, g, unknown or other
  misc_feature (217)..(217): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccccgttntttgtctccgaggggaaacagccaccctntcctgcaggccagtcagagtcttaggactctctagcctggtatcaacacgaacctggaccaggcctccaggcctcncatcatgatgcatccaacgnggccacgtgctactcccgagcctaggttccaggtcggcgtaggtcgggtcgtcgggaacaggtaccttcaaccgttctaccgacctattaccgaacgtacaacgacgttaacgacggtcccgttaaggtaaacggtttactttttacggaccgttttaaacgttttttaacgttaacgtttcggttaacctaacgggtaccgtaacgggttaaccgttaccggtaaacccgttaaacccgggttcccgggggtacccccggtttaacccgggggttaacccggggtttaccccggggtaaaccccggggtaaaaaccgggggggaaaaccccgtttaaaaaacggggggttcccgggaaaaaccgtttaaaccgggtaaacccggtaaacgggaaacccggtttaaaaccggtttccggggtaacggggtaccgtaacccgggttaccccaaacccggtttaccgttccggtttaccggtttttaccccg

SEQ ID NO: 275261 - DNA, 812 bp, Homo sapiens
  misc_feature: GYAE6OF01AC4AW.9.50.E06.1.454.CMB.1.raw
  modified_base (217)..(217): a, c, t, g, unknown or other
  misc_feature (217)..(217): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactcgtgcctccagtctccgacggagtagttgtgtacacactacgtcctacgacgccctaccgttgttcttcgtccacgggaaagggaacnccgtccctaccttctcgtcggccgaccgggtctacgtcgagttacgttcggtacggcttccttaccgtagcgtagtactacaacgacgtacgtcggaccgtacgccctaccgagtcctcctactacttcgtacgtagctacgacctaaccgaccggaacggtaccggcctaggtccgactacccgtcccgaacgtaccggttagtacgacgggtcgtacgggtacggtcggggttaaccgaggtaacctacgttaccttacccgtaccgttacctcccgtaaacctagacggaccgttacaacgtacgttaccggacgttaccgtaggtttaacgtttacctttcgggtaactttacggtttaacgtaccgttcgtaacgtacggtaacgtaccggttaactaacggtacccggtacgttacccgggtaccggtaaccgggtttacccggaaccgggtaacccggaaaccgggtccggttaaacggtcccgggtaaaccgtacgtaaaccgggtacggttaacccgggtaaggttcccgggtaaccgtaccgttaacccgggacctttacccggttagtttcccgttaaacccgg

SEQ ID NO: 275262 - DNA, 786 bp, Homo sapiens
  misc_feature: GYAE6OF01AORHA.9.50.E06.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (295)..(295): a, c, t, g, unknown or other
  misc_feature (295)..(295): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgctccaggggaaancgccacctntcctgcagggccagtcagngtctagganctccttagcctggtactcaacgagtaaacctggaccaggcctccgaggtcctcctnatctagtcgactgctactccgaacgcgggcctacgtcggactacgtcccgaggtccctagggtttcaggttcggactagggttcgggtactacggggtaactacggtacctttccgaacgtttcctaccgtaacccgtagttaccgaacggtaccctaaacgggtaaccgttacgggtaaccggtacccgtttaagggttaaaccgtttacgtttttacggaaccgttttaaacgggtttttaaccttaccggttacggttaaccgtaacggttaccggtaacgggttccgtttaacggaccgttaaaccggttccggggtaaccccgtttacggggttaacccggtttaccgggtaacccggtaaaacggggtaccctaaaacggggttccgtaaaccggttaacgtacccggtaaacggtcccggttaaaccggttcgggttaccggtaccgttacgggaaccctaaccgttacgttccggtttaccgg

SEQ ID NO: 275263 - DNA, 717 bp, Homo sapiens
  misc_feature: GYAE6OF01BWZRS.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaagacgcccaccctctcctgcgagggccagtcagagtcttaggagctccttagcctggtatacaacgaacgaaaccgtcggaccgacggcctcccgaggcctcctcatctatgatgcactaccgaacgacgggccacgtggaccacgtccccgagccgtaggttcgaggtcggcgagggttcgggtcgtacggggaactacggtacctttccgaccttccgtacccaacctagtaccgacgaccaacggtaaccgtaagggaccgtaccgttaaggtaaagtttacgtttttacgaccgttttaagttttaacttaccgttgtacgtaggtaccgtaggtccgtaacggcccgtaaaccggttccgggtacccggtttaccggggtacccggtttacccgggaaaccggtaaacgggggtaaacccgtaaagggtaccggaaaccgtacgtaaccggaacggtaccggttaacgtgggtcgggtaccgtacggacccaacgtcgttccgttaccg

SEQ ID NO: 275264 - DNA, 669 bp, Homo sapiens
  misc_feature: GYAE6OF01B5KH3.9.50.E06.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaancgccaccctntcctgcgagggccagtcagagtctaggnctcttagctggtatcaacagaaacctggaccaggcctaccgaggcctcctcatctatgatcgacactaccaacgcgggaccacgtcggaccaccgtaccccgacgaccgtaggttcaaggtcggacgtagggtcgggtacgtacggggactacggtaccttccgaccttctacctaccgatacgacgtaccaacgtaccgttaaggaccgtaccttaaggtaaccgttgttttacgacgtttaagttttaacttacgtacggttacacgtacgtaggtaccgtaacgcgtaaccgttcgggtcccgtacgggttaccgtaccgggaaccggtaaacgggaaacccggtaaggtaccgggaactacggtaacacgggtaaccacggttggtacggtcgtacgaaccgaccctagttccgttaaccg

SEQ ID NO: 275265 - DNA, 767 bp, Homo sapiens
  misc_feature: GYAE6OF01C10J3.9.50.E06.1.454.CMB.1.raw
  modified_base (206)..(206): a, c, t, g, unknown or other
  misc_feature (206)..(206): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagacttccaccggagaagttgtgttgacacagtctccagccaccctgtctttgtctccgaggggaaanacgccaccctctcctgcagggccagtcagagtcttaggagctccgttagcctggtatcaacaacgaaacctcggccacggcctccgaggcctcctcacttcatgattgccactacccaacgacgggccaactcggaccactcccccgaggtcccgtaagggtttccgaggttcgggacgtagggtcgggttacgcggggaacctacgtacctttccgaaccttccgtaccaccctaatccgacgaccgtaagtaccgttaagaccgtaccgttaaggtaaggttacgttttacgacgtttaaggttttaactttacggttacgtacgtaaggtccgtaacgggtacccgttacggtaacccggtaacgttcccggggtacccggtttacgggtaaccccggggtttacccggggaacccggaaaccgggggtaaacccgtaaaaggggttccggggaaacctaaccgggttaaccggaaaacgggtacccggtaaaccgttaggggttaccgggtacccgttacgggaacccgtaccccttaaggttcccgtttaacccgg

SEQ ID NO: 275266 - DNA, 785 bp, Homo sapiens
  misc_feature: GYAE6OF01AD7R8.9.50.E06.1.454.CMB.1.raw
  modified_base (206)..(206): a, c, t, g, unknown or other
  misc_feature (206)..(206): n is a, c, g, or t
  modified_base (322)..(322): a, c, t, g, unknown or other
  misc_feature (322)..(322): n is a, c, g, or t
  modified_base (773)..(773): a, c, t, g, unknown or other
  misc_feature (773)..(773): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaacngcccaccctctccgtgcacggggccagtcagagttcttagggatcttccttagcctggtactaccaacacgaaaccgtcggaccaggcctaccgaggtcctcctcatctagtgacncgactactccgaacgacgggacccacgtcggacctacgtaccccgagccgtaggttacgagggtcggacgtaggggttcggggtacgtacgggaccgtacgtacccgtttaccaacgtcctaccaccctacgtaccgaagaccgtagtaaccgtaacgggaccggtaccgttaagggtaaacggttttacgttttacgggtaaccgttttaaaggtttttaacctttaccggttagttacccggtaagtccggtaacggttacgggttaaccggtacgtaacccgggtttaccggggtacccgtttaacggggttacccggggtttaccgggaaacccgggttaaacgggggtaaccgtaaaacgggttacgggaaacccgtaacggttaaccggaaacggtaccggtaaacggttcgggttacgggtccctacggacccttaaaccggtnttccgtttaccg

SEQ ID NO: 275267 - DNA, 728 bp, Homo sapiens
  misc_feature: GYAE6OF01EA8YF.9.50.E06.1.454.CMB.1.raw
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccgacggagtaagttgtgttgacacagtctccagcccaccctgttctttgtctaccgaggggaaacncgccaccctctcctgcacgggccagtcagagtcttaggngcttcctagcctggtatcaanagaaacctggaccacgcctccgagcctcctnactntatcgntncctaatcccgaaacgcgggcctacgtcgacactcccgcgtaccgtacggttcgaggtcggactgggtggtcgtagggacaggtacctcacgtttacacccacgactacgacgtacccgaagtaccaacgggtaccgtacctaagggtaacgtttaattttcgtaacgtttaacgtttttaacttacgtggttaacgtaccggtaccgtaagggttacccgaacgtaaccggttaaccgggtccgggttaacccgtacccgggggttaacccggttaccggggaacccgggtaaaaacgggggttaccccgaaaagggtttaccccggaaacgttaacctaagggaaacccggtaccgttaaaacggtgggtacccggttacgacccctaccggaacttttcgcccgggttttaac

SEQ ID NO: 275268 - DNA, 768 bp, Homo sapiens
  misc_feature: GYAE6OF01CUBWJ.9.50.E06.1.454.CMB.1.raw
  modified_base (142)..(142): a, c, t, g, unknown or other
  misc_feature (142)..(142): n is a, c, g, or t
  modified_base (228)..(228): a, c, t, g, unknown or other
  misc_feature (228)..(228): n is a, c, g, or t
  modified_base (522)..(522): a, c, t, g, unknown or other
  misc_feature (522)..(522): n is a, c, g, or t
  modified_base (613)..(613): a, c, t, g, unknown or other
  misc_feature (613)..(613): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagnttcccaccgggtagtaagttggtagttgacctaacagttcctccacgccctacccgtgttctttcgtcctccgaagggggtaaacncgtcccctacccgtcctccgagcgacggggtccctaggtcgagtacgttacttaagggctcttcctagccgttcggtaataccgaacaacgtaacccgtggaacccgtcggtccctacccgacggtccttacccctatacttacgtagtcgaacgtcgaccgtaactacccgaacggacgggcctaaccggtggacccctaccgtcccgacggaccgttacggttcgacggtaggcctagggttccggacgttacggggctaacgttccgtttacaccgtttccgactacccgntaccggtacaccgttacgacgttacgagttacgtacgtaagtttgttaccgtatttaccggttacttacgtgtactaacgtcgtacggttnaaccgtacggttaaccgtcggttacccgtacggttaacccggtcgtaaccgggtaaacggtaccggaaacggttaggtaacctacgtacgggaaccgttaggttaacggtcgggttacgtccggtacgacccgttaactccgtacccgggtttac

SEQ ID NO: 275269 - DNA, 660 bp, Homo sapiens
  misc_feature: GYAE6OF01EY4EV.9.50.E06.1.454.CMB.1.raw
  modified_base (199)..(199): a, c, t, g, unknown or other
  misc_feature (199)..(199): n is a, c, g, or t
tcagtgatacgtctcacgaccggtgctcgatttagatctactgacaacacacaagggggaggaactgctcagttaggacccagagggaaccatggaagccccagctcagcttctcttcctctgctactctggctccagacttccacggagaagttgtgttgacacagtctccagccacctgtctttgctcgaggggaancgccacctctcctgcgagggccagtcagtagtcctaggacgtcctcgttagcctggtactacaacgagtaaacctggacctaggcctaccgacggtcctcctcattctagcgtactggccacgtacccgaaacgcgggacctagtcggactacctccgacggtctacggttacgaggtggcgtacggtcgggtcgtacgggacgtacgtacctttcaaccgtctacaaccttacacgaacgtaccaagtacgtacggaacgttcctaaggtaacgtttcgtttacggacgtttaacgttttaaactcgttagactacgacgtacggtacgttaacaccggtacgtccgtaaccgggtcggttaccgggtaccgggtaacgaaccgggtaaacgtaacggtaacggaccgttagaacgacggtacgtacggtcgtacggtactacgacgtctacggtcttcg

SEQ ID NO: 275270 - DNA, 754 bp, Homo sapiens
  misc_feature: GYAE6OF01B6S5B.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggagaactgctcagttaggacccagagggaaccatggaagccccagctcagcttctcttcctcctgctactctggcctcccagattccaccggagaagttgtgttgacacagtctcagccacctgtctttgtctccgaaggggaaacncgcccaccctctcctgcgagggccagtcagatcgtaggcgtctcctagccgtaggtactacgaaacgacgtaaaccgtcggaccaggtccctacccgaggtcccttccctacgtaacttcgtaagtcggacttacggacctaaccgtaacccgaaaccgtacggggaccctaacggttcgggacctaaccgtaccccgtaaggtaccccgtaaggggtttccaagggtcggaccggtaagggttcgggtacgtacggggaacctaggtacccttcaccgttcctaaccgaactacgtacgagacccgtaagtaacgtaacggacgtaccgtaagtaaacgtttatttacgaacgttttaagttttactaccgtgtacccgaagtccgaaggttccggtaacaccggtaacggtccgggtacccgtacggggttaccgttaccgggaaccggtaaagggtaaaccgtaaaggtcggaaccgtaacgtaaccgaaacggtaccggtaacgttcggacggtactaccgaacctaaccgttctaacggttccg

SEQ ID NO: 275271 - DNA, 682 bp, Homo sapiens
  misc_feature: GYAE6OF01AM3SH.9.50.E06.1.454.CMB.1.raw
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
  modified_base (462)..(462): a, c, t, g, unknown or other
  misc_feature (462)..(462): n is a, c, g, or t
tcagtgatacgtctcacgaccggtgctcgatttagatctactgacaacacacaaggggaggaactgctcagttagacccagaggaaccatggaagccccagctcagcttctcttcctcctgctactctggctcccagacttccaccggagaagttgtgttgacacagtcctccagccaccctgttcctttggtcctccgaggggaaanacgcctaccctctcctagccaggccaggtcagacgttctaggncctcgttagccgttgtatcaacagaaacctggccaggcctaccgaggtctccgtacattcctagtcgactgaccacgttcccaaaccgcgggtcccctaagtccggactaccgttaccccgaagtccccggtaaggttccaagggtcggtcgtaacggttcgggttcgacggggtaacaacgggttccctacgtactccgtaccacccgtnaccgtaagtcccaagggttaccacgcgtaccgtaagtacgttaagtttcgacgtttaacgtttagttaactcgtacgagtaccgacggttcgtaacgtcccgtaagtccggtcgtacggcccggttaggaccccggaagtaacgaaaccgggtactacgagttacccgaaggcgtaaaccgttggtaccggtcttaacggacccacttaccgtcttaacg

SEQ ID NO: 275272 - DNA, 776 bp, Homo sapiens
  misc_feature: GYAE6OF01ETF2Y.9.50.E06.1.454.CMB.1.raw
  modified_base (207)..(207): a, c, t, g, unknown or other
  misc_feature (207)..(207): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctccagacttccacggagtaagttgtgttgacacagtctccagccaccctgtctttgtctccgaaggggaaacncgcccaccctctcctgcgagggccagtcagtacgttcgttaaggacgtccttccgttacggcccgttaggtaactacgaaaaccgaacggaaaacccgtcgggacccgaacgggtccctaccccgtacggtcccttccctactattacctagtcgacgtcgacctacgtaacccgaaaccggacgggtccccaacgttcgggaccctaaccgttaccccgacggtacccgttaggggttcaagggttcggacggttagggttcggggtacgtacggggaactacgtaccttacctaaccgtttcccacgaaccttataccgacaaccgtaggtaacgtaaggaccgtacgttaagttaacggtttattttacgactttaaggttttactttacgtcgtacgtacgtacgacggtcgtaacgtacctaacggtccggtacccggtacgggtaccgttaccgggaaccgggaaacggtaaacccgttaaagggaccgaacgtaaccgtaacggaacggttccggtaacggtaggttcgaccgttaccgaaccgtacctagttccgttaccg

SEQ ID NO: 275273 - DNA, 967 bp, Homo sapiens
  misc_feature: GYAE6OF01C2SIR.9.50.E06.1.454.CMB.1.raw
  modified_base (217)..(217): a, c, t, g, unknown or other
  misc_feature (217)..(217): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagacttccaccggagaagttgtgtgacacagtctccagccacctgtctttgtctccgaggggaaacgcgccaccctcncctgcgacgggccagtcagtagtctaggagtcctccgttagcctaggtactacaaacgacgtaaacccgtggacccaacgggtccctacccgaacgggtccccttacccgtacctaacttcctttaaagtacgtaacgttaccggacctaaccgttaacccccgaaaccggaacgggggtaccccaacgttacggggaaccctaaccggtaccccccgaacggtacccgtaacgggtttactaaccggggtcgggaccggtaaaggggtttcgggggtaaccggttcgggggaaaccttacggggtacccttttaccggaaccctttaccctacccgtaaacccgtacttaaccgaaacggtacccgtaaacggttaaccgtaaacgggtaaccgttaccccgttaaagggttaaaacgtttacggtttttacgaaaccggttttaacggtttttaaaccgttaacccggttagttaacccgaacggtaccggttaacggtccggtttaacgaaccccggttaacggttccgggtaaccccgggttaacccgggggttaacccggtttacccggggaaacccgggtaaaaccggggttaaacccgggtaaaaacgggtttaccggggaaaaccgttaacccgggtaacccggtaaaaccgggttacccggtaaaacccgggtttacgggtaccgggttaaccccgtacggtacccgttaaacccccgacggttttacccgttaacccggg

SEQ ID NO: 275274 - DNA, 832 bp, Homo sapiens
  misc_feature: GYAE6OF01EPXLA.9.50.E06.1.454.CMB.1.raw
  modified_base (224)..(224): a, c, t, g, unknown or other
  misc_feature (224)..(224): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctccagacttccacggagaagttgtgttgacacagtctccacgccctacctgttctttgtcctccgaaggggaaacacgcccacccctcncctggccgacgggccagtcagtagttcgttaggacgtccttccgttacgccgttaggtactacaaacgacgtaaacccgtcgggacccagggccctcccgacggtccttcccgtactacgttactaagtggaacttcggacctacgtaaccccgaacggaccgggccctaacgttcggacctaaccgtccccgaacggtacccgttaggttaccgagggtcggacggtacgggttcgggtacgtacggggaacctcgtacccgttcgtacccgttacctacccaaccgtacgtaccgaacgtacccgtaaacgggtaaccgttaacgggacccgttaaccgttaaggttaaacggttttcgttttacggtaaccgtttttaagttttacgttacgttacgtacgtaacggtaccgtacggtacggttaaccgaccgtaacgggttcccggtaccgttaccggggttacccggtaccggggaaacccggtaaaccggggtaaacctaacggggtactaacccggtaacgttaaccggaacggttccgtaacgggtttcgggacccgttacccgtacgtaaccgtaacccgtttcgttccggtttacccg

SEQ ID NO: 275275 - DNA, 727 bp, Homo sapiens
  misc_feature: GYAE6OF01EWRET.9.50.E06.1.454.CMB.1.raw
  modified_base (208)..(208): a, c, t, g, unknown or other
  misc_feature (208)..(208): n is a, c, g, or t
  modified_base (583)..(583): a, c, t, g, unknown or other
  misc_feature (583)..(583): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagacttccacggagtaagttgtgttgacactagtctccagccctaccctgttctttgtctcgagggaanacgcccacctctcctgcacgggccagtcagtagttcttaggacgtcctccttacggcctaggtactaccgaaaccgaacgtaaacccgtcggacccgaggtccctcccgaggtccttaccctcgtaacttcgtaatcgaacttcgaccactacccaacggcgggaccacgtggaccactaccgagaccctagggttcaggtcggtcgtagggtcgggtcgtaggggaactcggttaacctccgtaactccgtaccacctactacgaccgtacaacgtacgtaaggaccgttacgtaaggtaacgtttagttttaccggattttaaaggttttacgttaccgtacggttacagggtactaacgggtcgtttaaccnccggtaacggttccgacccgggttccggtaaccggttacccggggaacgtaaaacggggtaccgtaaagggtacgtaaccgtacgtaccggaaagtaccggtaacggtcgtacgtacggtacccactacgttcgttccgttacg

SEQ ID NO: 275276 - DNA, 610 bp, Homo sapiens
  misc_feature: GYAE6OF01EVBB8.9.50.E06.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaancgccaccctgtcctgcaggccagtcagatcttagganctccttagcctggtactcaacagaaacctggccaggctccaggctcctnatctatgatgcatccaacncgggccagcggcactccagccaggttcaggtgcaggtgggtctagggaacaggtacttacgacttcgtacacctatacacgctaacgactaacggacgtaccgtagtaaggtttactttcgacgttaacggttttattacgtcgtacgacgcgacgtcgtaagaccgaacgttcgggacccgttacgggtaccggttacgggacccgtaaacggggtaacctaaagggtaccggaacgtacgtaacgaacggtaccggaacttcgggacgtactcggtaaccctaccggtacttcgtaccg

SEQ ID NO: 275277 - DNA, 828 bp, Homo sapiens
  misc_feature: GYAE6OF01C6HDB.9.50.E06.1.454.CMB.1.raw
  modified_base (209)..(209): a, c, t, g, unknown or other
  misc_feature (209)..(209): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggcctcccagacttccaccgggagtaagttggtgttgacacagtctccagccacctgtctttgtctccgaggggaanacgccaccctctcctgcgacggggccagtcgagtacgtcgttagggacgtccttccttagccgttggtactaccaacgaaggaaacccgtgggacccacgggtccctacccgagggtcccttccctacacttaccgttaagtcggtaattcggacctaactacccgaaacggacggggccctaacggtcgggaccaccgttaccccgacggtaccgtacggttcgacggtcgggtacgtaggggttcgggtacggtacggggaactacgggtacctttaccgaccgtttcctaccctaccgtacttaccggaacgtacctaacggtaaccgtaacggaaccgttaccgttaaggttaaaggtttacgtttttacggtaacccgttttaaggtttttaaccttacggttacggttaccgaacggttccgaacggtacgttaaccggtaccgtaaccgggttccgggtacccggttaccggggtaccgggtttacccgggaaaccggtaaaacggggtaccgtaaagggtacggaacctaaccggttacggaaaccggccggttaaacggtggttaacgggtcccgtacgtaccggtaaaccttcggttccgtttacccgg

SEQ ID NO: 275278 - DNA, 639 bp, Homo sapiens
  misc_feature: GYAE6OF01BQZGJ.9.50.E06.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccgagggaaanacgccaccctctcctgcagggccagtcagagtcttagagctcttagcctggtatcaacaggaacctggccaggcctccaggctcctcatcgtatgattgcctatccaaacngggccagtcggcactccagcccgaggttaccaggttggcctaggtcgggtctaggggactacggactttcaacttctaccgacctactacacggacctaagaccttaacggagaccgttaggaaagttacgtttttgaccgtttaaggttttacttttaaccgtgtttccgaaggtcaacggtacgtaagtaccgaaacgttcggaccctcgggtaccgttaccggacgtaacgggaccgtaaacggtaggtaaccgacgttacaacggtccgtaacgttacggacgggtccgtagtaccccgacgttaaccgttcgttaaccgg

SEQ ID NO: 275279 - DNA, 776 bp, Homo sapiens
  misc_feature: GYAE6OF01B1J3A.9.50.E06.1.454.CMB.1.raw
  modified_base (205)..(205): a, c, t, g, unknown or other
  misc_feature (205)..(205): n is a, c, g, or t
  modified_base (333)..(333): a, c, t, g, unknown or other
  misc_feature (333)..(333): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctccagccaccctgtctttgtctccgaggggaanacgccaccctctcctgcagggccagtcagagtcgttaggatcctccgttagcctaggtatacaaacacgaaaccgtcggaccgaacggcctacccgaggcctcctacattctatcgatcgacctaacnccgaaacgacgggacccaacgtcggacctacctccccggagacccgtaggttcgaaggtcgggctaggggtgggtccgtagggtaccaaggttaccttaccgacttccctacccaaccgtaacgtaccgaacgaccgtaacggtaaccgtaacgggtacccgtaccgtttaaacggtaaacggtttacgttttttacgaccgttttaaacggtttttaacgttaccgtttacggttaccgtaagtaccgtaacgggtaccggttaacggtaaccgtaaccgggttccgggtaaccccggtttaccgggggtaccggttacccgggaacccgggtaaaccgggaaaccgtaaaacggttacgggaaccgtaaaggtacccgtaaacggtccggtaaacggttacggtacggtcgtacggaccgtaccctagttcccgtttaccg

SEQ ID NO: 275280 - DNA, 837 bp, Homo sapiens
  misc_feature: GYAE6OF01C0XXB.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagacttccacggagaagttgtgttgacacagtctccagccacctgtctttgtctccgaggggaancgcccaccctctcctgccgacgggcctagtcagtacgtcgtagggactccttaccgttaggccttaggtaacttacaaacgtaacggtaaaacccgtcggaccaacgggtccctacccgagggcccttaccgtctaacgtctaagttcgaactcgacctaacgtacccgaacggtacgggtacccacggttcggacctaccgtaccccgaacggtacccgttaaggtttccgacgggttacgggccgtaaggggttcgggtacggttacgggaaccttaacgggtaccttactaaccgtcccgttaccaacctacgtaccgtaacgacgtaacgtaaccggtaggaacccggttacgtaaggttaacgtttacgttttagaacttttacggttttaaacttacgtaccgtacgtaacgggtcgtaacggtaacggtttaccggaaccgtttaccgggtaccggttacccgggttaccggggtaacccgggtttcggaaacccggggtaaaccggggtaaaccgtaaaaccgggttcgggaaactacggtaacccggtaaacggtcccgggtaacgttgggttaccccgggacttacccgtaacggtaaaccctttcggttccccgtttaacgg

SEQ ID NO: 275281 - DNA, 778 bp, Homo sapiens
  misc_feature: GYAE6OF01EJJAO.9.50.E06.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (632)..(632): a, c, t, g, unknown or other
  misc_feature (632)..(632): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaancgcccaccctntcctgcgagggccagtcagtagtcttaggacgtcttccgttagccgttggtactacaaacgacgtaaacccgtggaccaggtccctcccgaggtccctcctacactttaccgtagtcggtactcggtacctaacgtacccaaacggaccggggtacccctaacggttacgggaccctaaccgttacccccggaacgtaccccggtaaggggttttaccaacggggttccgggtaaacgtcgggggtttaacgggtcccggttaagggggaaccctagggttacccttacccggtacctacttacccaaccgtactccgaacgtaccaaggtacctaaggaccgtaccgtaaggttaagtttcgtttagtaccgtttaaggttttaactacgtgtacgacgtaccgtagtaccgtanaacccgtcgggtccgtaccggtaacgggttcggtaacccggaaccgggaaaggtaaacccgtaaggtaaccggacgtaacgtacgtaaacgggtcccgtagggttccggcgtacgttccgaaccgtaccttagttcccggttaacc

SEQ ID NO: 275282 - DNA, 710 bp, Homo sapiens
  misc_feature: GYAE6OF01AUC95.9.50.E06.1.454.CMB.1.raw
  modified_base (205)..(205): a, c, t, g, unknown or other
  misc_feature (205)..(205): n is a, c, g, or t
  modified_base (580)..(580): a, c, t, g, unknown or other
  misc_feature (580)..(580): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagattccaccggagaagttgtgttgacacagtcctccagccaccctgtctttgctccgaggggaanacgcccaccctctcctgcgacgggccagtcagagtcgttaggactctccttagcctggtactcaacgacggtaaacctcggaccaggcctacccgaggccttcctactacttcctagtcgacttcggacctacgtacccgaacggacgggtaccctaacgtcgggacctaacccgttcccccgaagtccccggttaagggtttacccgaaggggttcggaccgttagggtcgggtacggtacggggactacggtaccttccacgttccaccgactacgtcacgtcgaacgtaccgtaggactacgttaggaaacggtttctttacggtacttaagttttaacgttacctggtaccaggtacctagtccggttaanaccgtacgttccggaccgttacgggtacccgggtacgaaccgggaaccggaactaaacggggtacacgtaccgtacggaacggtacggtacgttacgggtcgtactacggactacccgtcgttcgttacg

SEQ ID NO: 275283 - DNA, 611 bp, Homo sapiens
  misc_feature: GYAE6OF01EHIWU.9.50.E06.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccaggggaaangccaccctctcctgcagggccagtcagagtcttaggagctcttagcctggtatcaacagaaacctggccaggcctccaggcctccnatctatgatgctatccaacgnggccactggcactccanccgaggttcaggtcggcaggtggtcgtacgggactaggtaccttcgactcctaccaaccgtatccaagtccaaggaccttaagacgtaccttaggaagtattttcggacttacgttttaattacgtgtacgagtacgacggtaccgtaagacctacgtaccgggtaccgtaccggtacggttaccgaaccggtaacggaaacgtaaacggtacggacgtaaacgtacgaacggtaccggtaagtacggacggtacgtacggacctaaccggtctcgttaccg

SEQ ID NO: 275284 - DNA, 689 bp, Homo sapiens
  misc_feature: GYAE6OF01BTPZ7.9.50.E06.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (335)..(335): a, c, t, g, unknown or other
  misc_feature (335)..(335): n is a, c, g, or t
  modified_base (674)..(674): a, c, t, g, unknown or other
  misc_feature (674)..(674): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccacctgttctttgtcctccgaggggaaancgcccaccctctcctgcaggccagtcagagtcttaaggngtccttccttagccgtggtactacaacaacgaaacctggacctacggcctacccgaggtcctccctacgacttctatggactgacctanacccgaagcgggaccacgtggcctactccccgagtccctaggttcagggtcggacgtaggttcgggtcggtacgggaacacgtacctttaccgaaccgttctaccaccgtaatccgacgtaccaaggtaccttaacggaacgtaccgttaagtaaacggtttctttttaggtaccgtttaaagttttaccgtttaacgttcgtaactacggtacgtacggtaccgtaacgacccgtaaccgttcgggtaccccgttacggtaccggttacggaaccgtaaacggggacctaaggtaccgagtacacgaacggtacgtaacgtcggtacgtctaccgacnccgttagtcttaccg

SEQ ID NO: 275285 - DNA, 697 bp, Homo sapiens
  misc_feature: GYAE6OF01CFU49.9.50.E06.1.454.CMB.1.raw
  modified_base (211)..(211): a, c, t, g, unknown or other
  misc_feature (211)..(211): n is a, c, g, or t
  modified_base (292)..(292): a, c, t, g, unknown or other
  misc_feature (292)..(292): n is a, c, g, or t
  modified_base (687)..(687): a, c, t, g, unknown or other
  misc_feature (687)..(687): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagattccaccggagtaagttgtgttgacacagtctccagcccaccctgtctttagtctaccgaggggaaacncgcccaccctctcctgcgacgggccagtcagtgtcttaggatctccttagctaggtatcaacagaacctggaccaggtccnccgagcctcctctatctagtacagtcgacacgtaccgaacgccgggccaacgtcgggcctaaccgtcccgagtccgtaggttccgaaggtcgggtactacgggttggggtacgtacgggaacagttaccttacgaccttccgtaccaccgtattcgaacgctaacgtaccgagtacgtaccgtaggtaatttacgtttcgaagttttacgttttacgtacgttacgttaccgaggtacgtaggtcccgttaacggaccgtaaccggttcgggttaaccgttaccggggtacgggttacccgggaaaccgggtaaaccggaaccggtaacgggtaagtaccgtaacgtacggaaccggtacgtacgtacgggttccgacgtacgtacccaacgttntccgttaacg

SEQ ID NO: 275286 - DNA, 681 bp, Homo sapiens
  misc_feature: GYAE6OF01DETGS.9.50.E06.1.454.CMB.1.raw
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagattccaccggagtaagttgtgttgacacagtctccagccacctgtcttgtctcgagggaaagcgccaccctctccgtgcagggccagtcagngtctaggnctcctagcctggtatacaacagaaaccgtgccaaggctccaggctccncatctatgatgctactacccgaacgacggggcccaacgttcgggacctaccgtaccccgaggtccctaagggtttaccagggtcggacgtacgggttcggggtaccttacgggggaactaaccgggtactttccggaaccttcccgtaccaaccgtactaccgtaacgaccgtaaacgtacgtaacgaacgtaccgtaagtaaagttacgtttttaggaacttttaaggtttaacttacgttagttaccgtaaggtcctaacggtcgtaacgtacgtaaccgtcgggaccgttcggtacgttcgggaaccgaacgggaactaaaacgggtcgaacggactacgaacgggaccgtaacggtcggtacggtcgacgtactaacgcttcgttacg

SEQ ID NO: 275287 - DNA, 823 bp, Homo sapiens
  misc_feature: GYAE6OF01E176X.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggatctcctagcctggtactcaacagaaacctggccaggcctaccaggctcctcactctactgatgctatacccaacgtacgggcccaacgttcgggacctaacgtccccgacgtacccgtagggtttaccgaagggttcgggtaccgtaacggggttcggggtacccgtttacgggggaaccgtaaggtttaacccgtttaccgtaaacccgttcccttaacccgaaccccgtaacttaccgaacggacccgtaaacggtaaccgtaacgggtaacgtacccgttaaggtaaacggttaacgttttttacgaaccgtttaaggtttttaaactttaaccgtttaccggttacgtaacggtaccgtaacgggtaccgttaacggacccgttaaaccggttccggggttaacccggttacggggttaaccccgggttacccggggtaacccggtaaaacccgggggtaaacccggtaaaaaccgggtacgggtaaacccgaacggttaccgtaaaaccgggtcccgtaaaacggttcggttacgggtaccggttacggacccgtacccttacgttccgttaacgg

SEQ ID NO: 275288 - DNA, 768 bp, Homo sapiens
  misc_feature: GYAE6OF01AXNOA.9.50.E06.1.454.CMB.1.raw
  modified_base (175)..(175): a, c, t, g, unknown or other
  misc_feature (175)..(175): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (289)..(289): a, c, t, g, unknown or other
  misc_feature (289)..(289): n is a, c, g, or t
tcagtgatacgtctcacgaccggtgctcgatttagatctactgacaacacacaagggggaggaactgctcagttaggacccagagggaaccagtggaacgccccagctcagcttctcttcctcctgctactctggctcccagtattccacggagaagttcgtgttgacacagtcnccagccacctgtcttgctcgagggaancgccaccgtctctgcgaggccaggtcagtgtctaggntctccttagcctggtatcaacagaaaccgtgccaggcctccaggctcctnatctatgatcgactacaccgaacggtacgggacccagttacggccaccgtaccccgaacggtccccgtagggtttacccgagggttcgggtaacgttcggggtggtacggtgggaaaccgtacggtacttaacgtcccgttactacccaacctaccgtacgaaccggaccgtaaaggttaccgtaacggttacccgttaacgtaacgggttaaaccgtttgtttaccgggtaaaccttttaaggttttaacgtacccgttttaaggcccgtaacggtacccgttaggggtaccaacgggttacccgtaaacggtcccgggtaccggtttaccgggacccggtttaacccgggaaccgggaaaggtaacccccgaaagggtttacccggaaacggtaccttaaccggggaaaccgtacgtaacccgggtttggaaccggttcccgaacggtacccctaacgttacgtttccgggttaccc

SEQ ID NO: 275289 - DNA, 922 bp, Homo sapiens
  misc_feature: GYAE6OF01ALADJ.9.50.E06.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctccagattccaccggagtagttgtgttgacacagtctccagccaccctgtcttgctcgaggggaancgccacctctcctgacncgggccagcagngtcttaggngctctagcctgtactacaacgacgtaactcgaccgagtcctaccaggtcctcctacagttcctagtacgagtcgacacgtaccaacggacgggtaccacggtaccggcaacgttccccgaaggtacccgttagggttacgaacgggtcgtaccggtacgggttaccggggtacggtaacgggtaaccgtaacccgttacgttttacccgaaccgtttcccgtaacccgtaacccgtacgttaaccggaaccgttaaccggtaacggtaaccggttaaccgggaaccggttaaacccggtttaacggtaaacggggtttaaactttttccgggttaaaaccccttttaaggggtttttaaacccttttaaccgggtttcgtttaaaaccggtacccggtttaaccgggttaacggtacccgggtttaaaaccgtacccggttaaacccgggtttccccgggggttaacccggtttaacccggggtaacggggttttaccccggaaaccggggttaaaccccgggtaaacggtaaaccgggttaaacggggtaacccgtaaccggtttaaaccgggaaaaccgggtaaaccgggttaaacccgggttacgggtttaccggggtaccccgtttaaaggggaaccccccttttaaaccgggcggttttaccccggttttaaacccggg

SEQ ID NO: 275290 - DNA, 1008 bp, Homo sapiens
  misc_feature: GYAE6OF01AWZFG.9.50.E06.1.454.CMB.1.raw
tcagtgatacgtctcacgaccggtgctcgatttagatctactgacaacacacaagggggaggaactgctcagttaggatccagagggaaccatggaagccccagctcagcttctcttcctcctgctactctggcctccagattccacggagtaagttgtgttgacactagtactccagcctacccttgttccttttgtcctaccgaaggggaaacacgccctaccctcctcctgcacgggccagtcagtagttcgtaggacgtccttaccttagccgttaggttactaccgtaaacgaaacggtaaaacccgttcgggacccgtaacgggtacccttaccccgtaacgggtccctttacccctaccgttaaccgtttcctttaaagttacgggtaacttcggtacccttaaccgttaaaccccggaaaaccgggtaaccgggggtacccccttaaccggttacccgggtaacccttaacccgttacccccggtaaaccgtcccgggttaaacggggttttaccaacgggggtttacggggacccggttaacgggggtttcgggggtttacccggttaacgggggaaacccgttaaccgggtttaaccctttttaaccccgaacccgttacccgttacccctaaaccccgtaaccgttacgaacccggtaaccggtaaccgggtaaacccgttaacggtaaccggtaaccttaaacggggttaaacgtttacgttttttaacggtaaaccgttttaagggttttttaaaccttacgtttaacggtacctaaccggtacggttaaccggtacgggtaaaccggtaccgttaacgggtttacccgggtaacccgtttaccggggtaacccggtttacccgggaaaccgggtaaacccgggaaacccggttaaaggtacccggggtaaacctacggttaaaccggtaacggtaccggtaaccggttaccgggtaccgtacgtaacccgtacttaaccgttaccgggttaccc

SEQ ID NO: 275291 - DNA, 713 bp, Homo sapiens
  misc_feature: GYAE6OF01A8QJ0.9.50.E06.1.454.CMB.1.raw
  modified_base (98)..(98): a, c, t, g, unknown or other
  misc_feature (98)..(98): n is a, c, g, or t
  modified_base (212)..(212): a, c, t, g, unknown or other
  misc_feature (212)..(212): n is a, c, g, or t
  modified_base (679)..(679): a, c, t, g, unknown or other
  misc_feature (679)..(679): n is a, c, g, or t
tcagtgatacgtctcacgaccggtgctcgatttagatctactgacaacacacaagggggagaactgctcagttaggacccagagggaaccatggaacnccccagctcagcttctcttcctcctgctactctggcctcccagtacttccaccggagtaagttgtgttgacacagtctccagcccacctgttcttgtcctccgaaggggtaacncgcccaccctctccgtgacgacgggtacaagtcaggtagtacgttaggacgtccttaccgttacgccgtaggtactacgaacgtaacgaaaccgtcggacctacggtacctaccgacggtcctccgtactacttactacgtaggactcgaccgtactaaccgaacggaccgggtaccacggtcggtacctacgtaccgacggtaccgttacggtaccgtgggtaccggtagtgggttcgggtacgtacgggaactacgtcctactctccgtaccactacgtcacgactacgacgtacggcctaccgtaaagtacgtttagttacgtacttttaacggttacttacgcgttacagtaccgacgtccggtaacgtccaacccggggttaccgtccgggttaaccgtaccggtaccgggaaccgtaaagggtaacctaggtaacccgtatacggaacggaggttaacccngggtacgtcgctacgaccctattccgtcgttacg

SEQ ID NO: 275292 - DNA, 912 bp, Homo sapiens
  misc_feature: GYAE6OF01BO6DO.9.50.E06.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggcctccagattccaccggagaagttgtgttgacacagtctccagccacctgtcttgctcgaggggaancgccacctctccnggcagggccagtcaggtacgttcgttagggagtccttaccgtttaggcccgttggtaactaccgaaaaccgaacggaaaacccgtgggacccacggggccctacccgacggtccttccctacaacttctaatcggtattcggacctaacgtacccgaaaaccggacgggggaccctaccggttcgggacccaaccgttccccccgaagggcccccgttaaagggggttttcccgaagggttcggggacgtaacgggggtttcgggggtacggttacgggggaaacctaacggttcctttaccgaaccctttaccctacccggtaaccgtacctacgaaccggaaccctaacgggtaaccgttaaccgggtacggtaacccgttaagggtaaaagttttaccgttttttacggaaccgtttttaaagggtttttacctttaaccggtacggttaaccgtaccgggtaaccgtacgggtaccgttaaccgggacttacccgggttacgggtaccccgtttacgggggttaacccggttacccgggaaaccggggttaaaccggggaaacccttaaaggggtaaccgggtaaccgtaaacggttaaaccgggaacgggttacccgggtaaaggttcccgggttacgggtacgttaaccccggtaaccgtaacccctttacgttcccgggttttaaccccgg

SEQ ID NO: 275293 - DNA, 499 bp, Homo sapiens
  misc_feature: GYAE6OF02HR7TR.9.50.E06.1.454.CMB.1.raw
  modified_base (203)..(203): a, c, t, g, unknown or other
  misc_feature (203)..(203): n is a, c, g, or t
tcagtgatacgtctcacgaccggtgctcgatttagatctactgacaacacacaaggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccacctctcctgcagggccagtcagagtcttaggagctccttagcctggtatcaacagaaacctggccaggctcccaggctcctcatctatgatgcatccaacgacgggccacgtggcactcccagccaggttcagtggcagtggtctgggacagacttcactctcaccatcagcagactagacgcctagaagtattttgctagtttatactgtcagcagcgtagcaacgtggcctcggtacgttcggaccaagggaccaagtgacatacaagcgaactgtgctgcacatctcg

SEQ ID NO: 275294 - DNA, 490 bp, Homo sapiens
  misc_feature: GYAE6OF02IP82Y.9.50.E06.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (478)..(478): a, c, t, g, unknown or other
  misc_feature (478)..(478): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccaccctctcctgcagggccagtcagagtcttaggagctccttagcctggtatcaacagaaacctggccaggctcccaggctcctcatctatgatgcatccaacngggccactggcatcccagccaggttcagtgcagtgggtctgggacagacttcactctcaccatcagcagactagagcctagaagtattttgctagttttattactgtcagcagcgtagcaactggcctcggacgttcggccaagggaccaagtgacatcaagcgatgngctgcacatctg

SEQ ID NO: 275295 - DNA, 504 bp, Homo sapiens
  misc_feature: GYAE6OF02IT8P6.9.50.E06.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttagganctccttagcctggtatcaacagaaacctggccaggctcccaggctctcatctatgatgcatccaangggccactggcatcccagccaggttcagtggcagtgggtctgggacagcttcactctcacatcagcagactagacgcctagaagtattttgctagtttattactgtcagtcagcgtagcaacgtggcctcgggacgttcggaccgaagggaccaaggtggacagtaccaagcgaactgtacgctgcaccatctcg

SEQ ID NO: 275296 - DNA, 510 bp, Homo sapiens
  misc_feature: GYAE6OF02H17L2.9.50.E06.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacngggccactggcatcccagccaggttcagtggcagtgggtctgggacagacttcactctcaccatcagcagactagagcctagaagtattttgcttagttttattactgtacagcagcgtagccaactcggccttacgggccgttcggaccgaagggaccaagtggacatacaagcgaactggtaggctgacacatctcg

SEQ ID NO: 275297 - DNA, 504 bp, Homo sapiens
  misc_feature: GYAE6OF02HM9VF.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggccactggcatcccagccaggttcagtgcagtgggtctgggacagacttcactctcaccatcagcagactagagcctagaagtattttgctagttttatacttgtcagcagcgtagcaacgtggcctcggacgttcggaccgaacgggaccaagtggacgatacaagcgaacgtgtcggctgcacatctcg

SEQ ID NO: 275298 - DNA, 515 bp, Homo sapiens
  misc_feature: GYAE6OF02GFPQ9.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctagaagtattttgcttagtttattactgtcagcagcgtagcaactcggcctcggtacgttcggaccgaagggaccaaggtcggaacgagtacaaggccgaacgtgtggctagaccacctatctcg

SEQ ID NO: 275299 - DNA, 544 bp, Homo sapiens
  misc_feature: GYAE6OF02H22IJ.9.50.E06.1.454.CMB.1.raw
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
  modified_base (368)..(368): a, c, t, g, unknown or other
  misc_feature (368)..(368): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangccaccctctcctgcagggccagtcagagtcttaggagctccttagcctggtatcaacagaaacctggccaggctccaggctcctcatctatgatgcatccaacngggccactggcatcccagccaggttcagtggcagtgggtctgggacagacttcactcncacatcagcagactagagcctagaacgtattttagactagttttactacttgtacagctagcgtaagctaacgtcggaccgttgggtaccgttcggaccgaacgggacgaacggtaggaccaagtacgaacggaccgtaaccgtggttacggccgtagaccgacctactcgttacg

SEQ ID NO: 275300 - DNA, 604 bp, Homo sapiens
  misc_feature: GYAE6OF02I623Y.9.50.E06.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (380)..(380): a, c, t, g, unknown or other
  misc_feature (380)..(380): n is a, c, g, or t
tcagtgatacgtctcacgaccggtgctcgatttagatctactgacaacacacaaggggaggaactgctcagttaggacccagagggaaccatggaagcccagctcagcttctcttcctcctgctactctggctcccagattccaccggagaagttgtgttgacacagtctccagccaccctgtctttgtctccaggggaaanagccacctctcctgcagggccagtcagagtcttaggagctccttagcctaggtatcaacagaaacctggaccaaggctacccaggctccnactctatgatgcatccaacngggccaactggctactcccagccaggttccagtcggcaggttgggtctagggacagtacgttcacgtntccaaccgtatcagcaagactagacgctagaatacttttacggcttaggtttaacttacgttgtacctaggactacgtacgttacggtactaacgttcggaccttacgggtaccgttacggaccgtaaacggggtacctaagggtacggtaacgtaaccgtaacgtaaccggtactaacggtcgtttaagggcggtttacgccgaaccgtcgttacccgttagg

SEQ ID NO: 275301 - DNA, 498 bp, Homo sapiens
  misc_feature: GYAE6OF02FGH0G.9.50.E06.1.454.CMB.1.raw
  modified_base (203)..(203): a, c, t, g, unknown or other
  misc_feature (203)..(203): n is a, c, g, or t
  modified_base (470)..(470): a, c, t, g, unknown or other
  misc_feature (470)..(470): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccaccctctcctgcagggccagtcagagtcttaggagctccttagcctggtatcaacagaaacctggccaggctcccaggctcctcatctatgatgcatccaacagggccactggcatcccagccaggttcagtgcagtgggctgggacagacttcactctcaccatcagcagactagagcctgaagtattttgctagtttattactgtcagcagcgtagctaacgtcggcctcggacgttcggccgaagggaccaagtgacgancaagcgaactgtcggctgcaccatctcg

SEQ ID NO: 275302 - DNA, 518 bp, Homo sapiens
  misc_feature: GYAE6OF02IMD8W.9.50.E06.1.454.CMB.1.raw
  modified_base (203)..(203): a, c, t, g, unknown or other
  misc_feature (203)..(203): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccaccctctcctgcagggccagtcagagtcttaggagctccttagcctggtatcaacagaaacctggccaggcctcccaggctcctcatctatgatgcatccaacacgggccactggcactcccagccaggttcagtgcaggtggtctgggacagacttcactctcaccatcagcagacagagcctagaagtattttgcttagttttatacttgtcagcagcgtagcaacgtcggcctcgggtacggttcggaccgaacgggaccaaggtcggacgtatacgaagcgaacgtggtcggctgccacgtatctcg

SEQ ID NO: 275303 - DNA, 507 bp, Homo sapiens
  misc_feature: GYAE6OF02H2BUS.9.50.E06.1.454.CMB.1.raw
  modified_base (204)..(204): a, c, t, g, unknown or other
  misc_feature (204)..(204): n is a, c, g, or t
  modified_base (356)..(356): a, c, t, g, unknown or other
  misc_feature (356)..(356): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgccagggccagtcagagtcttaggagctccttagcctggtatcaacagaaacctggccaggctcccaggctcctcatctatgatgcatccaacagggccatggcatccagccaggttcagtgcagtgggtctgggacngacttcactctcactatcagcagactagagcctgaagattttgctagtttattactgtcagcagcgtagcaacgtggcctggacgttcggaccgaagggaccaagtggaacagtaccaagccgaactgtacggctgaccaaccagtcttcg

SEQ ID NO: 275304 - DNA, 496 bp, Homo sapiens
  misc_feature: GYAE6OF02HFKRN.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtgcagtgggtctgggacagacttcactctcaccatcagcagactagagcctgaagtattttgctagtttattactgtcagcagcgtagcaactggcctcggacgttcggccaagggaccaagtgacgatacaagcgaactgtggctgcaccatctcg

SEQ ID NO: 275305 - DNA, 522 bp, Homo sapiens
  misc_feature: GYAE6OF02GAD52.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggccacgtggcatcccagccaggttcagtgcagtgggtctgggacagtacttcactctccacatcagcagactagacgcctagaagtattttgacttagtttattactgtcagcagtcgtagctaacgtcggcctcgggtacgttcggaccgaacgggaccaagtcggactaagtaccgaagacgaactggtaggctagcactactctcg

SEQ ID NO: 275306 - DNA, 548 bp, Homo sapiens
  misc_feature: GYAE6OF02GN2DK.9.50.E06.1.454.CMB.1.raw
  modified_base (204)..(204): a, c, t, g, unknown or other
  misc_feature (204)..(204): n is a, c, g, or t
  modified_base (444)..(444): a, c, t, g, unknown or other
  misc_feature (444)..(444): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggcctcctcatctatgatgcatcccaacgagggcccacgtggccactccccagccaggttcagtcggcaggtgggtctgggacagacttcactctcaccatcagcagactagacgcctagaagtattttgcttaagtttattacgtgtcagcagtcgtanctaacgtggcctcggtacgttccggaccgaacgggaccgaaggtacggactaagtaccaaggaccgtaacgtggtacggctacggacctaccgtactcgttacg

SEQ ID NO: 275307 - DNA, 583 bp, Homo sapiens
  misc_feature: GYAE6OF02FL01E.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggcccacgtggcatccccagccaggttcagtggcagtgggtcgtgggacagacttcactctacaccatcagcagactagacgcctgaagtattttgacgttagtttattacgtgtacagctagcgtagacctaacgtcggacccgttacgggtaccgttcgggacccgtaacggggaacccgtaacgggtacgggaaccgtaagtaaccgaaacggtaccggtaaccgtaggttcgggaccgttagacccgtaaccgtacgttccgttacg

SEQ ID NO: 275308 - DNA, 530 bp, Homo sapiens
  misc_feature: GYAE6OF02H0AN2.9.50.E06.1.454.CMB.1.raw
  modified_base (525)..(525): a, c, t, g, unknown or other
  misc_feature (525)..(525): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacgacgggccactggcactcccagccaggttcagtcggcaggtgggtctgggacagtacttcactctcaccatcagcagactagacgtctagaagtattttgacttagtttattacgtgtcgagcgagtcgtacgactaacgtcggccgtcggtacgttcggaccgaagggaccgagtcggacagtacaagacgtaacgtgacggcgtgacctacgntctcg

SEQ ID NO: 275309 - DNA, 514 bp, Homo sapiens
  misc_feature: GYAE6OF02F8ZFO.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacgagggccacgtggcactccccagccaggttcagtggcagtgggtctgggacagcttcactctcaccatcagcagactagagcctgaagtattttgacttagtttattactgtcagtcagtcgtagcaacgtggcctcggtacgttcggccaagggaccaagtggacgtatacaagcgtaacgtgtcggcgtagctaccatctcg

SEQ ID NO: 275310 - DNA, 588 bp, Homo sapiens
  misc_feature: GYAE6OF02H8WZQ.9.50.E06.1.454.CMB.1.raw
  modified_base (204)..(204): a, c, t, g, unknown or other
  misc_feature (204)..(204): n is a, c, g, or t
  modified_base (582)..(582): a, c, t, g, unknown or other
  misc_feature (582)..(582): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggatctccttagcctggtatcaacagaaacctgccaggctcccaggctctcatctatgatgcatccaacgcgggccactggacactcccagccaggttcaggtcgcaggtggtctgggacagtacttcactcacaccatcgacacagaactagacgcctagtaagttattttcggacttagtttttaactacgttcgttacagacgtacgacggttaacgtaacgttcggaccgttacggaccgtttaccggaccggtaaacgggaccgtaaacggtcgtaacgacggtccgaacggtacgtaacgttcgtacgggtctacggtacccaaccgtcttaccgtnttaccg

SEQ ID NO: 275311 - DNA, 528 bp, Homo sapiens
  misc_feature: GYAE6OF02G3LT7.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacgagggccactggcactccccagccaggttcagtggcaggtgggtctgggacagacttcactctcaccatcagcagactagacgcctagaagtattttgacttagtttattactgtcagcagtcgtagctaacgtggcctcggaccgttcggaccgaacgggaccaaggtcggaactagtacgaaggacgtaacgtggtcggactggaccactatctcg

SEQ ID NO: 275312 - DNA, 511 bp, Homo sapiens
  misc_feature: GYAE6OF02IGY3Y.9.50.E06.1.454.CMB.1.raw
  modified_base (204)..(204): a, c, t, g, unknown or other
  misc_feature (204)..(204): n is a, c, g, or t
  modified_base (508)..(508): a, c, t, g, unknown or other
  misc_feature (508)..(508): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctccaagattccaccggagaagttgtgttgacacagtctccagccaccctgtctttgtctccaggggaaanagccaccctctcctgcagggccagtcagagtcttaggagctccttagcctggtatcaacagaaacctggccaggctccaggctcctcatctatgatgcatccaacagggcccactggcatccccagccaggttcagtggcaggtgggtctggggacagacttcactctccaccatcagcagactagagcctagaagtattttgcttagtttattactgtcagcagcgtagcaacgtcggcctcggacgttcggccgaacgggacaagtcggacgatcaagcgaactgtcggctgaccactactntcg

SEQ ID NO: 275313 - DNA, 779 bp, Homo sapiens
  misc_feature: GYAE6OF02IMUZB.9.50.E06.1.454.CMB.1.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccaccctctcctgcagggccagtcagagtcttaggagcctccttagcctggtatcaacagaacctggccgagcctaccgngtcctcactactactagtagagtcgactactaaccaacggaccggtcctacgtcggacctaccgtaccacgtacgtacgtacgagggtcggacgtacggggttcgggtacggtacggggaaactacggttacctaccgtaaccttccctaacccgtacaacttaccgaaccggtactaaacgggtacgtaaacggcccggtaacgtaaggtaaacgttttacgttttaccggtaaaggtttttaaccgtttttaaactttaccggttagttaaacccgtacggtaccggtaacggtaccggttaaaccggtaacttaccgggtcccgggttaccgggttacccggggttaacgggttaccccggaaaaccggggtaaacgggtaaacccggtaacgggttacggaacctaaccggttaaacggaaccggtaacccgttaaggtacggggttcgttacccggtacggaacccctaaacgtccgttttagtacccg

SEQ ID NO: 275314 - DNA, 514 bp, Homo sapiens
  misc_feature: GYAE6OF02FZXM7.9.50.E06.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccaccctctcctgcagggccagtcagagtcttaggagctccttagcctggtatcaacagaacctggccaggctcccaggctcctcatctatgatgcatccaacngggcccagtggcactcccagccaggttcagtggctaggtgggtctgggacagacttcactctcacatcagcagactagagcctagaagtattttgacttagtttattactgtacagcagcgtagcaacgtggaccgtcggacgttcggaccgaagggaccaagtgacagacgaacgacgtacgtgtcggactgcaccgtatctcg

SEQ ID NO: 275315 - DNA, 551 bp, Homo sapiens
  misc_feature: GYAE6OF02GHKNP.9.50.E06.1.454.CMB.1.raw
  modified_base (204)..(204): a, c, t, g, unknown or other
  misc_feature (204)..(204): n is a, c, g, or t
  modified_base (385)..(385): a, c, t, g, unknown or other
  misc_feature (385)..(385): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggcctcctcatctatgatgcatccaacgacgggcccacgtggaccactccccagccaggttcagtggcaggtgggtctgggacagacttcactctcacctntcagcagactagacgcctagaagtatttgacttaagttttacttacgtgttacagtcgagtcgtagcctaacgttcggaccttcgggacgttccggaccgtaacgggaccaaggtcggaacaagtacgaagacgtaacgtggtcggtactcgacctaccatcgtcg

SEQ ID NO: 275316 - DNA, 539 bp, Homo sapiens
  misc_feature: GYAE6OF02IRTG3.9.50.E06.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccaggggaanagccaccctctcctgcagggccagtcagagtcttaggagctccttagcctggtatcaacagaaacctggccaggctcccaggcctcctcatctatgatgcatccaacngggccagtggcactccccagcctaggttcagtggcaggtgggtcngggacagacttcactcncaccatcagcagactagagctagaagtnttttgcttaagttttattactgtcagcagtcgtagcgaacgtcggccgtacggaccgttcggacgaacggaccgtaagtcggacgaacgtaccgaaggaccgtaacgtggtacggcgtacgacctacctacgtcgtacg

SEQ ID NO: 275317 - DNA, 530 bp, Homo sapiens
  misc_feature: GYAE6OF02GXNHH.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccacctctcctgcagggccagtcagagtcttaggagctccttagcctggtatcaacagaaacctggccaggcctcccaggctcctcatctatgatgcatccaacagggccactggcactcccagccaggttcagtggcaggtgggtctgggacagacttcactctcaccatcagcagactagacgcctagaagtattttgcttaagtttacttacgtgtctagcgtagtcgtagctaacgtggaccgttcgggtacggttccggaccgtaacgggaccaaggtcggaacgatacgaagcgtaacgtggtgctagccacatctcg

SEQ ID NO: 275318 - DNA, 559 bp, Homo sapiens
  misc_feature: GYAE6OF02I3055.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacacgggcccacgtcggcacgtccccagcccaggttcaggtggcaggtcgggtctggggacagtacttcgactctcaccatcacgcagactagagtcctagaagtatttgacttagtttacttacgtgtcagcagtcgtagctaacgtcggtccgtcggtaccgttcggaccgaacgggtaaccaaggtgacgtaacgtaccgaacgaccggtaacgttggtcggtacgtcggaccaccgtataccgttcg

SEQ ID NO: 275319 - DNA, 519 bp, Homo sapiens
  misc_feature: GYAE6OF02HSGAW.9.50.E06.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (429)..(429): a, c, t, g, unknown or other
  misc_feature (429)..(429): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccagggaaangccacctctcctgcagggccagtcagagtcttaggagctccttagcctggtatcaacagaaacctggccaggctcccaggctcctcatctatgatgcatccaangggccactggcatcccagccaggttcagtgctaggtgggtctgggacagtacttcactctcaccatcagcagactagagcctagaagtattttgacttagtttattactgtcagcagcgtancaacgtcggcctcggacgttccggacgaacgggaccaagtcggaacagtaccaaggcgaacgtcggtaggctacgaccacctagtctacg

SEQ ID NO: 275320 - DNA, 530 bp, Homo sapiens
  misc_feature: GYAE6OF02I99CC.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (381)..(381): a, c, t, g, unknown or other
  misc_feature (381)..(381): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccacctctcctgcagggccagtcagagtcttagganctccttagcctggtatcaacagaaacctggccaggctcccaggcctcctcatctatgatgacatccaacgacgggccacgtggcactccccgagccaggttccagtggcagtgggtctggggacagcttcactctcacntccagcagactagagcctagaagtattttgacttagtttattactgtcagcagtcgtagctaacgtcggcctcgggtaccgttcggaccgaagggaccaggtacgacgtaatacgaaggtacgactggcggtctcgacacgtatcgtcg

SEQ ID NO: 275321 - DNA, 506 bp, Homo sapiens
  misc_feature: GYAE6OF02F9L9O.9.50.E06.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttagganctccttagcctggtatcaacagaaacctggccaggctccaggctcctcatctatgatgcatccaacagggccactggcactcccagccaggttcagtggcaggtgggtctgggacagacttcactctcaccatcagcagactagacgcctagaagtattttgacttagttttattactgtcagcagcgtagcaacgtggcctcgggacgttcggacgaagggaccaagtggacatacaagcgtaactgtcgctgcacatctcg

SEQ ID NO: 275322 - DNA, 642 bp, Homo sapiens
  misc_feature: GYAE6OF02JMMQ1.9.50.E06.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagtgatacgtctcacgaccggtgctcgatttagatctactgacaacacacaagggggaggaactgctcagttaggacccagagggaaccagtggaagccccagctcagcttctctttcctcctgctactctggctcccagattccaccggagaagttgtgttgacacagtctccagccacctgtctttgctccgaggggaangccacctctcctgcagggccagtcagngtcttaggnctcctagcctggtactcaagacgaaacctggacccaggcctcccgaggtcctccnagttctagtnacgttcgccatcccgaaagtccgggcctacgtggccaccgtcccgaagtccgtaaggttcagtcgggcaggttcggtacgtgggactacggtacctttcgacctcacacctagtcgactacgtagacctagtacgcgtagtaagtcttttacgacgtttaagtttaacgttcttggccgtaacggtcttaacggacggttaacgaccgtaaccgtcgggtccgttaaccgggttaccggttcggaaccggtacgggtaaacccgtagttaacgggacctacgaagtaaccggaccgaacgttcggacggttcgtacgaccggtaactcgtcgttacg

SEQ ID NO: 275323 - DNA, 565 bp, Homo sapiens
  misc_feature: GYAE6OF02GXGEJ.9.50.E06.1.454.CMB.1.raw
  modified_base (204)..(204): a, c, t, g, unknown or other
  misc_feature (204)..(204): n is a, c, g, or t
  modified_base (413)..(413): a, c, t, g, unknown or other
  misc_feature (413)..(413): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggcctcccaggcctcctcatctatgatgcatccaacgacgggccagtggcactcccagcctaggttcaggtggctaggtcgggtctagggacagtacttcactctcacctatcagcagactagacgcctagaacgtnttttcgacttagttttattacgttgtacagtacacgtcgtagctaacgtcggtacccgtcggtaccggttcggaaccgaagggtaccaaggtcggaacgtaagtacgaacgaccgaacgttggtacggcgtcgaccaccgtacgtcttacgg

SEQ ID NO: 275324 - DNA, 644 bp, Homo sapiens
  misc_feature: GYAE6OF02ITQJ4.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgagggaaangccacctctcctgcagggccagtcagagtcttaggagctcctagcctggtatcaacacgaaacctggaccacggcctacccgaggtcctcctcattcctatagatcgacacgtaccaaacgacgggcccaacgtggacctactccccgaagccgtaaggtccaggtcgacgtacggtggtctagggacaggtaacctttcacttcctacgacctagtaccagtaccaagaccgttaagcgtaccgtagaaacgttagttttacgacgttaaggtttttacttaacgttgtaccgtagtaccgaggttaccgttacaccgtaaccgtccggtaaccgttccgggtacggttacccggaccggtaaacggaccgtaacgttggaaccgtacgtacgaacggacgtaacccgtggtacgcgtagaccaccttaagtcgttacg

SEQ ID NO: 275325 - DNA, 554 bp, Homo sapiens
  misc_feature: GYAE6OF02IP26Z.9.50.E06.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (427)..(427): a, c, t, g, unknown or other
  misc_feature (427)..(427): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangcccaccctctcctgcagggccagtcagagtcttagganctccttagcctggtatcaacagaaacctggccaggcctccccgaggcctcctcattctatgattgcactccaacgacgggccacgtggcactcccagcctaggttcaggtggctaggtcgggtctcgggactagtacctttcacttctaccacctatcagacagactagacgctagaacgttntttgacttagtttattacgttgtacagctagtcgtagactaacgtcggccgttcggtacgttccggaccgaaggacctaaggtggacagtaccgaaggcgtacgtggtacgctgaccactagtctcg

SEQ ID NO: 275326 - DNA, 541 bp, Homo sapiens
  misc_feature: GYAE6OF02G2JO1.9.50.E06.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (417)..(417): a, c, t, g, unknown or other
  misc_feature (417)..(417): n is a, c, g, or t
  modified_base (453)..(453): a, c, t, g, unknown or other
  misc_feature (453)..(453): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaangccaccctctcctgcagggccagtcagagtcttagganctccttagcctggtatcaacagaaacctggccaggcctcccaggctcctcatctatgatgcatccaacgcgggcccacgtggcactccccagccaggttcaggtcggcaggtgggtctggggaacagtaccttcaccttctaccacctatcgagcagactaggacgcctagaagtnttttgacttagttttattacgtgtacagcagcgtanactaacgtcggccgtcggtacgtccggacgaagggaccaaggtcgacagtacaaggacgtaagtggtacggctacgaccactgtctcg

SEQ ID NO: 275327 - DNA, 522 bp, Homo sapiens
  misc_feature: GYAE6OF02GFBFD.9.50.E06.1.454.CMB.1.raw
  modified_base (203)..(203): a, c, t, g, unknown or other
  misc_feature (203)..(203): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaanagccaccctctcctgcagggccagtcagagtcttaggagctccttagcctggtatcaacagaaacctggccaggctcccaggcctcctcatctatgatgcatccaacagggcctactggcactcccagccaggttcagtggcaggtgggtctgggacagtacttcactctcaccatcagcagactagacgctagaagtatttgacttagttttattactgtcagcagcgtagcaacgtcggcctacgggtcgttcggacgaacgggaccaagtcggacgatacgaagaccgtaactggtacggctcgaccactatctcg

SEQ ID NO: 275328 - DNA, 525 bp, Homo sapiens
  misc_feature: GYAE6OF02HQJPE.9.50.E06.1.454.CMB.1.raw
  modified_base (204)..(204): a, c, t, g, unknown or other
  misc_feature (204)..(204): n is a, c, g, or t
  modified_base (520)..(520): a, c, t, g, unknown or other
  misc_feature (520)..(520): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggcctccccaggctcctcatctatgatgcatccaacacgggccactggcactccccgagccaggttcaggtggcaggtgggtctgggacagacttcactctcacatcagcagactagagcctagtaagtattttgcttaagttttattacttgtacagcagcgtagctaacgtcggcctcggtaccgttcggaccgaagggaccaaggtacggacgatacgaagcgaacgtgtcggcgtgcacntctcg

SEQ ID NO: 275329 - DNA, 557 bp, Homo sapiens
  misc_feature: GYAE6OF02GDJOY.9.50.E06.1.454.CMB.1.raw
  modified_base (243)..(243): a, c, t, g, unknown or other
  misc_feature (243)..(243): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttagganctcttagcctggtatcaacagaaacctggccaggcctccgaggctcctcatctatgatgcatcccaaacgcgggccacgtggccactcccagccaggttcagtggcaggtgggtcngggacagtacttcactcaccacatcagcagactagacncctagaagtnttttgacttaagtttattactgtcagcaggtcgtagactaacgtcggaccgtcgggtacgttccggaccgtaacgggaaccgtaggtcggaacgtaacgtacgaacggaccgtaagtggtacggcctacggacccacgtacgttctacgg

SEQ ID NO: 275330 - DNA, 544 bp, Homo sapiens
  misc_feature: GYAE6OF02F64OI.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (395)..(395): a, c, t, g, unknown or other
  misc_feature (395)..(395): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttagganctccttagcctggtatcaacagaacctggccaggcctcccaggcctcctcatctatgatcgcactccaacgacgggcccacgtggccactaccccgagcctaggttccaggtggctaggttcgggtctaggggacagtacttcactctccacntcagcagactagacgtctagaatgttttgacttagtttattactgtcagtcagcgtagctacgtggacctcggcgtcggaccgtaacgggacctaaggtcggaactagtaccaacgcgtacgtggtcgtctacggacaccgtactctcg

SEQ ID NO: 275331 - DNA, 535 bp, Homo sapiens
  misc_feature: GYAE6OF02FIGUT.9.50.E06.1.454.CMB.1.raw
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccgaggcctcctcatctatgatgcatccaacgagggccacgtggccatccccagccaggttcagtgcaggtgggctgggacagtacttcacttcncaccatcagcagactagagcctagaagtntttgcttagtttattacgtgtcagcagtcgtancaacgtcggccttcgggacgttcggaccgtaacgggaccaaggtcggactacgaccgaagcgtaacgtggtcggtctagacctaccgtattcctacg

SEQ ID NO: 275332 - DNA, 519 bp, Homo sapiens
  misc_feature: GYAE6OF02HW085.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
  modified_base (513)..(513): a, c, t, g, unknown or other
  misc_feature (513)..(513): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattcccaccggagaagttgtgttgacacagtctccagccacctgtctttgtctccaggggaaangccaccctctcctgcagggccagtcagagtcttagganctccttagcctggtatcaacagaaacctggccaggctcccaggctcctcatctatgatgcatccaacngggccactggcatcccagccaggttcagtgcaggtgggtctgggacagacttcactctcaccatcagcagactagagtcctagaagtattttgctagtttattactgtacagtcagcgtagctaacgtggacctcggacgttcggaccgaagggaccaaggtcggacgatacgaagtacgtaacgtgtacggcgtagcacctntctacg

SEQ ID NO: 275333 - DNA, 514 bp, Homo sapiens
  misc_feature: GYAE6OF02GVZ8E.9.50.E06.1.454.CMB.1.raw
  modified_base (204)..(204): a, c, t, g, unknown or other
  misc_feature (204)..(204): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggcccactggcatcccagccaggttcagtggcaggtgggtctgggacagcttcnctcncacatcgancagactagacgacctagaagtatttgcttagtttattactgtcagcagcgtagcaacgtcggccttcggacgttcggccgaacgggaccaaggtggacatacgaacgcgaacgtgtcggctcgacacctatctcg

SEQ ID NO: 275334 - DNA, 583 bp, Homo sapiens
  misc_feature: GYAE6OF02GHT6G.9.50.E06.1.454.CMB.1.raw
  modified_base (205)..(205): a, c, t, g, unknown or other
  misc_feature (205)..(205): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaangccaccctctcctgcagggccagtcagagtcttaggagctcttagcctggtatcaacagaacctggccaggctccagctcctcatctatgatgcatccaacgcgggccacgtggcactcccgagcctaggttcaggtgctaggtgggtctgggacagaccttcactctaccacatacgagcaagacagagccgtagaagttntttcgattagtttattacgtgtacngacgtagtcgtagactaacgtggtacccgttacgggtaccgttaccggaccgtaaacgggaccgtaagggtacggaacgtaacgtaccgtaacggtaccggtaacgttcggtacggtacgtaccgacccgtaaccgttactccggtttacg

SEQ ID NO: 275335 - DNA, 774 bp, Homo sapiens
  misc_feature: GYAE6OF02JA79Y.9.50.E06.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagccacctctcctgcagggccagtcagagtcttaggnctccttagcctggtatcaacagaaacctggccagggcctccccgaggcctccgtactatcctagtaggaatcgctaactcccaaacgacggggtcccaacgttcgggacaccgtccccgaaggcccctaaggggttccaagggttcgggacctacggggttcgggggtaccttacggggggaactaacggtacctttacccgtaaccgttccttacccgaacccgttaagtcccgtaacgtaccgtaacgtaaaccgttacggaacgtaccgttaaggtaaacggttaagttttttaccggaacgtttaacggtttttaacgttacccgtttaggtaccgtaacgtcgtaacggtaccggttaacgtaccgtaaaccggttcgggtaccccggttacgggttaacccgggtttccggaacccggtaaacggggtacccgttaaaacggtcgggtaaccgtaacgtaaccggtaacggtaaccgttaacgtacggttcggaccgtacgtaccgtaccgtacgtacgttaccgg

SEQ ID NO: 275336 - DNA, 510 bp, Homo sapiens
  misc_feature: GYAE6OF02JCLBO.9.50.E06.1.454.CMB.1.raw
  modified_base (203)..(203): a, c, t, g, unknown or other
  misc_feature (203)..(203): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (433)..(433): a, c, t, g, unknown or other
  misc_feature (433)..(433): n is a, c, g, or t
  modified_base (487)..(487): a, c, t, g, unknown or other
  misc_feature (487)..(487): n is a, c, g, or t
  modified_base (505)..(505): a, c, t, g, unknown or other
  misc_feature (505)..(505): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccagggaaanagccaccctctcctgcagggccagtcagagtcttaggagcctccttagcctggtatcaacagaaacctggccaggctccaggctcctcatctatgatgcatccaacagggccaacgtggcatcccagccaggttcagtggcaggtgggtcngggacagtaccttnactcgtcaccatcagcagactagacgtccagagtatttgcttagtttatactgtcagcagcgtancgaactcggcctaggacgttccggaccgaaggtaccaagtgacgatacgaacgngactgtggctcgacactntctcg

SEQ ID NO: 275337 - DNA, 543 bp, Homo sapiens
  misc_feature: GYAE6OF02FGLI3.9.50.E06.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (408)..(408): a, c, t, g, unknown or other
  misc_feature (408)..(408): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggagctccttagcctggtatcaacagaaacctggccaggctcccaggcctcctnatctatgatgcatccaacagggccacgtggcactccccagcctaggttcaggtggcaggtgggtctggggacagtacttcactctccaccatcagcagactagagcctagtaagtntttgacttagtttattctgtcagcagcgtagctaacgtgaccgtcggacgttccggaccgaacgggtaccaaggtcggaacgagtaccgaacgacgtaaccgttggtacggcgtacgacctaaccgtatcgttcg

SEQ ID NO: 275338 - DNA, 596 bp, Homo sapiens
  misc_feature: GYAE6OF02IG7RR.9.50.E06.1.454.CMB.1.raw
  modified_base (201)..(201): a, c, t, g, unknown or other
  misc_feature (201)..(201): n is a, c, g, or t
  modified_base (480)..(480): a, c, t, g, unknown or other
  misc_feature (480)..(480): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgctcaggggaaancgccaccctctcctgcagggccagtcagagtcttaggagctccttagcctggtactcaacagaaaccctggccaggcctccgaggcctcctcattctactgatgcataccaacacgggaccacgtcggctactccccgagccctaggttcaggtcggacgtaggtcgggtcgtaggaccgaagtcttcactcctacaccagtcagacaagtacctaggcgtaccgtaagtacggttattttcgacgttagttttaatcgttagtccagctagtacgtanacgacgtcggcccgttcgggacgttcggacccgtaaaggggcctaaacggtcggaactacgtaaacgacggaccgtaagtcgggtacggtacctccggacctaacgtctccgttcg

SEQ ID NO: 275339 - DNA, 667 bp, Homo sapiens
  misc_feature: GYAE6OF02IUN10.9.50.E06.1.454.CMB.1.raw
  modified_base (205)..(205): a, c, t, g, unknown or other
  misc_feature (205)..(205): n is a, c, g, or t
  modified_base (289)..(289): a, c, t, g, unknown or other
  misc_feature (289)..(289): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaancgccaccctctcctgcagggccagtcagagtcttaggagctccttagcctggtatcaacagaacctggccaggctccaggctcncatctatgatgcactccaacgagggcccacgtggccactcccagccaggtttccaggtcggctaggtgggtcgtggggaactagtaccgttacacttccgttaccaacctataccgacgacaagaacctacggacgtcccgtagaaacgttacgtttttgaccttaaggtttttaacttacgttgttccgtaagtcgagtccggttaagaccgtaaaccgtcggtacccgttaccggggtaaccggtttaccggaacccggaaacggggtaacccgtaacgggttaacgggaaaccgtacgttaaccgaaacggtacccgtaaacggtttacggttcggtaccgttacggacccgaacccgttagttacccgttccgg
